US008129588B2

(12) United States Patent
Nuccio et al.

(10) Patent No.: US 8,129,588 B2
(45) Date of Patent: Mar. 6, 2012

(54) REGULATORY SEQUENCES FOR EXPRESSING GENE PRODUCTS IN PLANT REPRODUCTIVE TISSUE

(75) Inventors: Michael L. Nuccio, Research Triangle Park, NC (US); L. Mark Lagrimini, Apex, NC (US); Moez Meghji, Bloomington, IL (US)

(73) Assignee: Syngenta Participations AG, Basel (CH)

( * ) Notice: Subject to any disclaimer, the term of this patent is extended or adjusted under 35 U.S.C. 154(b) by 532 days.

(21) Appl. No.: 11/109,594

(22) Filed: Apr. 19, 2005

(65) Prior Publication Data

US 2007/0006344 A1    Jan. 4, 2007

Related U.S. Application Data

(60) Provisional application No. 60/563,687, filed on Apr. 20, 2004, provisional application No. 60/563,678, filed on Apr. 20, 2004.

(51) Int. Cl.
*C12N 15/82* (2006.01)
*A01H 5/00* (2006.01)
*A01H 5/10* (2006.01)

(52) U.S. Cl. .......... 800/287; 536/24.1; 435/320.1; 435/419; 800/298; 800/320.1; 800/320.2

(58) Field of Classification Search .......... None
See application file for complete search history.

(56) References Cited

U.S. PATENT DOCUMENTS

| | | | |
|---|---|---|---|
| 5,593,874 A | 1/1997 | Brown et al. | 435/172.3 |
| 5,753,475 A | 5/1998 | Houck | 435/172.3 |
| 5,850,020 A | 12/1998 | Bloksberg et al. | |
| 5,866,791 A | 2/1999 | Holt | |
| 5,952,486 A | 9/1999 | Bloksberg et al. | |
| 5,959,178 A | 9/1999 | Fritig et al. | |
| 5,981,837 A | 11/1999 | Chapple | |
| 5,990,386 A | 11/1999 | An | 800/290 |
| 6,066,780 A | 5/2000 | Boudet et al. | |
| 6,140,554 A | 10/2000 | O'Reilly et al. | 800/287 |
| 6,204,434 B1 | 3/2001 | Bloksberg et al. | |
| 6,211,432 B1 | 4/2001 | Boudet et al. | |
| 6,228,645 B1 | 5/2001 | Bruce et al. | 435/424 |
| 6,239,329 B1 | 5/2001 | Weigel et al. | 800/278 |
| 6,342,657 B1 | 1/2002 | Thomas et al. | 800/287 |
| 6,410,826 B1 | 6/2002 | Yanofsky et al. | |
| 6,441,272 B1 | 8/2002 | Ye | |
| 6,537,604 B1 | 3/2003 | Ethington, Jr. | |
| 6,552,249 B1 | 4/2003 | Cahoon et al. | |
| 6,610,521 B1 | 8/2003 | Choon | |
| 6,610,908 B1 | 8/2003 | Chapple | |
| 6,846,677 B2 | 1/2005 | Yanofsky et al. | |
| 6,855,864 B2 | 2/2005 | Chiang et al. | |
| 2002/0032917 A1 | 3/2002 | Benfey et al. | 800/278 |
| 2002/0081693 A1 | 6/2002 | Cahoon et al. | |
| 2002/0138870 A1 | 9/2002 | Chiang | |
| 2003/0106106 A1 | 6/2003 | Takakura et al. | 800/287 |
| 2003/0131373 A1 | 6/2003 | Bloksberg et al. | |
| 2003/0159170 A1 | 8/2003 | Cahoon | |
| 2004/0014116 A1 | 1/2004 | Cahoon et al. | |
| 2004/0016024 A1 | 1/2004 | Wang et al. | 800/286 |
| 2004/0045053 A1 | 3/2004 | Greenland et al. | 800/284 |
| 2004/0060084 A1 | 3/2004 | An et al. | 800/287 |
| 2004/0214272 A1 | 10/2004 | La Rosa et al. | |

FOREIGN PATENT DOCUMENTS

| | | |
|---|---|---|
| CA | 2005597 | 12/1989 |
| WO | WO 93/05159 | 3/1993 |
| WO | WO 93/05160 | 3/1993 |
| WO | WO 94/23044 | 10/1994 |
| WO | WO 97/12982 | 4/1997 |
| WO | WO 98/03535 | 1/1998 |
| WO | WO 99/10498 | 3/1999 |
| WO | WO 00/22099 | 4/2000 |
| WO | WO 01/34817 | 5/2001 |
| WO | WO 01/73090 | 10/2001 |
| WO | WO 01/95702 | 12/2001 |
| WO | WO 02/26994 | 4/2002 |
| WO | WO 2003/018819 | 3/2003 |
| WO | WO 03/087313 A2 | 10/2003 |
| WO | WO 2004/048595 | 6/2004 |
| WO | WO 2004/099413 | 11/2004 |
| WO | WO 2004/099414 | 11/2004 |
| WO | WO 2006/094976 | 9/2006 |
| WO | WO 2006/104891 | 10/2006 |

OTHER PUBLICATIONS

Fernandez D.E. et al. The embryo MADS domain factor AGL15 acts postembryonically. Inhibition of perianth senescence and abscission via constitutive expression. Plant Cell. Feb. 2000;12(2):183-97.*

Sieburth, L.E. et al. Molecular dissection of the AGAMOUS control region shows that cis elements for spatial regulation are located intragenically. Plant Cell. Mar. 1997;9(3):355-65.*

Wilkie G.S. et al. Regulation of mRNA translation by 5'—and 3'-UTR-binding factors. Trends Biochem Sci. Apr. 2003;28(4):182-8. Review.*

Jeon J.S. et al. leafy hull sterile1 is a homeotic mutation in a rice MADS box gene affecting rice flower development. Plant Cell. Jun. 2000;12(6):871-84.*

Garg A.K. et al. Trehalose accumulation in rice plants confers high tolerance levels to different abiotic stresses. Proc Natl Acad Sci U S A. Dec. 10, 2002;99(25):15898-903. Epub Nov. 27, 2002.*

Ishida Y. et al. High efficiency transformation of maize (*Zea mays* L.) mediated by *Agrobacterium tumefaciens*. Nat Biotechnol. Jun. 1996;14(6):745-50.*

(Continued)

*Primary Examiner* — Cynthia Collins

(74) *Attorney, Agent, or Firm* — Myers Bigel Sibley & Sajovec, P.A.

(57) ABSTRACT

Expression cassettes causing specific regulatory control of transgene expression in plants, wherein the expression cassettes include regulatory sequences from the MADS gene family for expression of recombinant gene products in the reproductive tissue of plants for the purpose of generating abiotic stress tolerant plants.

19 Claims, 13 Drawing Sheets

OTHER PUBLICATIONS

Sieburth L.E. et al. Molecular dissection of the Agamous control region shows that cis elements for spatial regulation are located intragenically. Plant Cell. 1997 Mar.;9(3):355-65.*

Cacharrón et al., "Expression of MADS box genes *ZMM8* and *ZMM14* during inflorescence development of *Zee mays* discriminates between the upper and the lower floret of each spikelet," *Dev Genes Evol* (1999) 209: 411-420.

Kang et al., "Isolation and Characterization of a Rice MADS Box Gene Belonging to the *AGL2* Gene Family," *Mol. Cells* (1997) vol. 7, No. 1: 45-51.

Larkin et al., "Arabdiopsis *GLABROUS1* Gene Requires Downstream Sequences for Function," *The Plant Cell*, vol. 5: 1739-1748, Dec. 1993.

Lopez-Dee et al., *OsMADS13*, A Novel Rice MADS-Box Gene Expressed During Ovule Development, *Developmental Genetics*, 25: 237-244 (1999).

Moon et al., "Determination of the Motif Responsible for Interaction between the Rice APETALA1/AGAMOUS-LIKE9 Family Proteins Using a Yeast Two-Hybrid System," *Plant Physiology*, Aug. 1999, vol. 120: 1193-1203.

Sieburth et al., "Molecular Dissection of the *AGAMOUS* Control Region Shows That *cis* Elements for Spatial Regulation Are Located Intragenically," *The Plant Cell*, vol. 9: 355-365, Mar. 1997.

Yu et al., "Identification and Characterization of Three Orchid MADS-Box Genes of the AP1/AGL9 Subfamily during Floral Transition," *Plant Physiology*, Aug. 2000, vol. 123: 1325-1336.

Aoki et al., "Molecular Cloning and Expression Analysis of a Gene for a Sucrose Transporter in Maize (*Zea mays* L.)," *Plant Cell Physiol.*, 40(10), pp. 1072-1078, 1999.

Huijser et al., "Bracteomania, an inflorescence anomaly, is caused by the loss of function of the MADS-box gene *squamosa* in *Antirrhinum majus*," *The EMBO Journal*, vol. 11, No. 4, pp. 1239-1249, 1992.

Callis et al. (1987) "Introns increase gene expression in cultured maize cells" *Genes and Development* 1:1183-1200.

Ballard et al. "Effect of Corn Silage Hybrid on Dry Matter Yield, Nutrient Composition, In vitro Digestion, Intake by Dairy Heifers, and Milk Production by Dairy Cows" *J Dairy Science* 84:442-452 (2001).

Chung et al. "Early Flowering and Reduced Apical Dominance Result from Ectopic Expression of a Rice MADS Box Gene" *Plant Molecular Biology* 26:657-665 (1994).

Dwivedi et al. "Modification of Lignin Biosynthesis in Transgenic *Nicotiana* Through Expression of an Antisense O-Methyltransferase Gene from *Populus*" *Plant Molecular Biology* 26:61-71 (1994).

GenBank Accession No. AF153195.1, *Solanum tuberosum* class 1 chitinase (ChtC2) gene, complete cds, Oct. 2, 2003 (2 pages).

International Search Report and Written Opinion for International Application No. PCT/US05/13245 dated Dec. 4, 2006 (13 pages).

International Search Report and Written Opinion for International Application No. PCT/US2006/10795 dated Jul. 1, 2008 (11 pages).

Jack. "Plant Development Going MADS" *Plant Molecular Biology* 46:515-520 (2001).

Jang et al. "Expression of a Bifunctional Fusion of the *Escherichia coli* Genes for Trehalose-6-Phosphate Synthase and Trehalose-6-Phosphate Phosphatase in Transgenic Rice Plants Increases Trehalose Accumulation and Abiotic Stress Tolerance Without Stunting Growth" *Plant Physiology* 131:516-524 (2003).

Kang et al. "Phenotypic Alterations of Petal and Sepal by Ectopic Expression of a Rice MADS Box Gene in Tobacco" *Plant Molecular Biology* 29:1-10 (1995).

Koehler et al. "A Human Epithelium-Specific Vector Optimized in Rat Pneumocytes for Lung Gene Therapy" *Pediatric Research* 48(2):184-190 (2000).

Lapierre et al. "Structural Alterations of Lignins in Transgenic Poplars with Depressed Cinnamyl Alcohol Dehydrogenase or Caffeic Acid O-Methyltransferase Activity Have an Opposite Impact on the Efficiency of Industrial Kraft Pulping" *Plant Physiology* 199:153-163 (1999).

Morrow et al. "Molecular Characterization of a Brown Midrib3 Deletion Mutation in Maize" *Molecular Breeding* 3:351-357 (1997).

Oba and Allen. "Effects of Brown Midrib 3 Mutation in Corn Silage on Dry Matter Intake and Productivity of High Yielding Dairy Cows" *J Dairy Science* 82:135-142 (1999).

Piquemal et al. "Down-Regulation of Caffeic Acid O-Methyltransferase in Maize Revisited Using a Transgenic Approach" *Plant Physiology* 130:1675-1685 (2002).

Roa-Rodriguez. *Promoters Used to Regulate Gene Expression*, Chapters 1 and 2, Cambia Inellectual Property Resource pp. 1-81 (2003).

Supplementary European Search Report for European Application No. 05737647, dated Jun. 30, 2008 (3 pages).

* cited by examiner

FIG. 10

REGULATORY SEQUENCES FOR EXPRESSING GENE PRODUCTS IN PLANT REPRODUCTIVE TISSUE

REFERENCE TO MATERIAL SUBMITTED ON COMPACT DISC

The Sequence Listing associated with the instant disclosure has been submitted as a 1.01 MB file on CD-R (in duplicate) instead of paper. Each CD-R is marked in indelible ink to identify the Applicants, Title, File Name (Text only-MADS promoter seq.listing.ST251.txt), Creation Date (Mar. 20, 2006), Computer System (IBM-PC/MS-DOS/MS-Windows), and Docket No. (70369USNP). The Sequence Listing submitted on CD-R is hereby incorporated by reference into the instant disclosure.

FIELD OF THE INVENTION

The present invention includes expression cassettes that contain regulatory sequences derived from a target gene, for example, regulatory sequences from the MADS gene family, for tissue specific expression of recombinant gene products in plants.

BACKGROUND OF THE INVENTION

In agricultural biotechnology, plants can be modified according to one's needs. One way to accomplish this is by using modern genetic engineering techniques. For example, by introducing a gene of interest into a plant, the plant can be specifically modified to express a desirable phenotypic trait. For this, plants are transformed most commonly with a heterologous gene comprising a promoter region, a coding region and a termination region. When genetically engineering a heterologous gene for expression in plants, the selection of a promoter is often a critical factor. While it may be desirable to express certain genes constitutively, i.e. throughout the plant at all times and in most tissues and organs, other genes are more desirably expressed only in response to particular stimuli or confined to specific cells or tissues.

Promoters consist of several regions that are necessary for full function of the promoter. Some of these regions are modular, in other words they can be used in isolation to confer promoter activity or they may be assembled with other elements to construct new promoters. The first of these promoter regions lies immediately upstream of the coding sequence and forms the "core promoter region" containing consensus sequences, normally 20-70 base pairs immediately upstream of the coding sequence. The core promoter region contains a TATA box and often an initiator element as well as the initiation site. The precise length of the core promoter region is not fixed but is usually well recognizable. Such a region is normally present, with some variation, in most promoters. The base sequences lying between the various well-characterized elements appear to be of lesser importance. The core promoter region is often referred to as a minimal promoter region because it is functional on its own to promote a basal level of transcription.

The presence of the core promoter region defines a sequence as being a promoter: if the region is absent, the promoter is non-functional. The core region acts to attract the general transcription machinery to the promoter for transcription initiation. However, the core promoter region is insufficient to provide full promoter activity. A series of regulatory sequences, often upstream of the core, constitute the remainder of the promoter. The regulatory sequences determine expression level, the spatial and temporal pattern of expression and, for a subset of promoters, expression under inductive conditions (regulation by external factors such as light, temperature, chemicals and hormones). Regulatory sequences may be short regions of DNA sequence 6-100 base pairs that define the binding sites for trans-acting factors, such as transcription factors. Regulatory sequences may also be enhancers, longer regions of DNA sequence that can act from a distance from the core promoter region, sometimes over several kilobases from the core region. Regulatory sequence activity may be influenced by trans-acting factors including general transcription machinery, transcription factors and chromatin assembly factors.

Frequently, it is desirable to have tissue-specific expression of a gene of interest in a plant. Tissue-specific promoters promote expression exclusively in one set of tissues without expression throughout the plant; tissue-preferred promoters promote expression at a higher level in a subset of tissues with significantly less expression in the other tissues of the plant. For example, one may desire to express a value-added product only in corn seed but not in the remainder of the plant. Another example is the production of male sterility by tissue-specific ablation.

Tissue specific promoters may be expressed in specific tissue at a specific time or times during the plant growth cycle. However, sufficient expression levels of gene products, especially those gene products directed to expression in specific tissues, is difficult to obtain. Iyer M., et al. (2001). It is known that the 5' untranslated leader sequence of mRNA, introns, and the 3' untranslated region of mRNA effect expression for particular genes. For example, Sieburth, L. E. and Meyerowitz, E. M. (1997) show that intragenic sequences appear to be necessary for the expression of the AGAMOUS (AG) gene, an *Arabidopsis* MADS box gene, in the distinct expression patterns of normal early and later flower development. Larkin J. C., et al. (1993) show that deletion of the 3' noncoding region of the *Arabidopsis GLABROUS*1 (GL1) gene negatively affects GL1 function. However, to date, identifying and specific regulatory regions and incorporating them into a robust trait delivery platform has not been accomplished.

Important aspects of the present invention are based on the discovery that DNA sequences from the MADS gene family are exceptionally useful in the development of robust expression cassettes that express recombinant genes in the reproductive tissues of plants.

SUMMARY OF THE INVENTION

The present invention includes a number of different aspects, including specific regulatory control of transgene expression in plants by identifying regulatory sequences from the MADS gene family and incorporating such sequences into expression cassettes for expression of recombinant gene products in the reproductive tissue of plants.

The present invention relates to a method of constructing expression cassettes by identifying the target gene, using the relevant cDNA sequence to annotate the gDNA sequence for the purpose of identifying regulatory sequences of the target gene, and incorporating one or more of the regulatory sequences into an expression cassette with a nucleic acid molecule. A plant transformed with an expression cassette of the invention expresses the product of the nucleic acid molecule in a manner that mimics the expression of the target gene.

The present invention relates to the specific regulatory control of transgene expression in plants, and includes targeting transgene expression to developing reproductive tissue in maize, rice and other monocots. Use of the expression cassettes of the present invention includes expressing a glucose or sucrose transporter to increase reproductive sink strength. Sink strength can also be increased by flower-specific expression of an invertase gene or one or more of the trehalose metabolism genes. The invention further encompasses enhancing the capacity for small molecule uptake via increased expression of specific transporters.

DEFINITIONS

The terms "open reading frame" and "ORF" refer to the amino acid sequence encoded between translation initiation and termination codons of a coding sequence. The terms "initiation codon" and "termination codon" refer to a unit of three adjacent nucleotides ('codon') in a coding sequence that specifies initiation and chain termination, respectively, of protein synthesis (mRNA translation).

The term "abiotic stress" refers to nonliving environmental factors such as frost, drought, excessive heat, high winds, etc., that can have harmful effects on plants.

The term "nucleic acid" refers to a polynucleotide of high molecular weight which can be single-stranded or double-stranded, composed of monomers (nucleotides) containing a sugar, phosphate and a base which is either a purine or pyrimidine. A "nucleic acid fragment" is a fraction of a given nucleic acid molecule. In higher plants, deoxyribonucleic acid (DNA) is the genetic material while ribonucleic acid (RNA) is involved in the transfer of information contained within DNA into proteins. A "genome" is the entire body of genetic material contained in each cell of an organism. The term "nucleotide sequence" refers to a polymer of DNA or RNA which can be single- or double-stranded, optionally containing synthetic, non-natural or altered nucleotide bases capable of incorporation into DNA or RNA polymers. Unless otherwise indicated, a particular nucleic acid sequence of this invention also implicitly encompasses conservatively modified variants thereof (e.g. degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer, et al., Nucleic Acid Res. 19:5081 (1991); Ohtsuka, et al., J. Biol. Chem. 260:2605-2608 (1985); and Rossolini, et al., Mol. Cell. Probes 8:91-98 (1994)). The term nucleic acid is used interchangeably with gene, cDNA, and mRNA encoded by a gene.

"Operably-linked" refers to the association of nucleic acid sequences on a single nucleic acid fragment so that the function of one is affected by the other. For example, a promoter is operably-linked with a coding sequence or functional RNA when it is capable of affecting the expression of that coding sequence or functional RNA (i.e., that the coding sequence or functional RNA is under the transcriptional control of the promoter). Coding sequences in sense or antisense orientation can be operably-linked to regulatory sequences.

"Promoter" refers to a nucleotide sequence, usually upstream (5') to its coding sequence, which controls the expression of the coding sequence by providing the recognition for RNA polymerase and other factors required for proper transcription. "Promoter regulatory sequences" consist of proximal and more distal upstream elements. Promoter regulatory sequences influence the transcription, RNA processing or stability, or translation of the associated coding sequence. Regulatory sequences include enhancers, promoters, untranslated leader sequences, introns, and polyadenylation signal sequences. They include natural and synthetic sequences as well as sequences that may be a combination of synthetic and natural sequences. An "enhancer" is a DNA sequence that can stimulate promoter activity and may be an innate element of the promoter or a heterologous element inserted to enhance the level or tissue specificity of a promoter. It is capable of operating in both orientations (normal or flipped), and is capable of functioning even when moved either upstream or downstream from the promoter. The meaning of the term "promoter" includes "promoter regulatory sequences."

"Primary transformant" and "T0 generation" refer to transgenic plants that are of the same genetic generation as the tissue that was initially transformed (i.e., not having gone through meiosis and fertilization since transformation). "Secondary transformants" and the "T1, T2, T3, etc. generations" refer to transgenic plants derived from primary transformants through one or more meiotic and fertilization cycles. They may be derived by self-fertilization of primary or secondary transformants or crosses of primary or secondary transformants with other transformed or untransformed plants.

"Gene" refers to a nucleic acid fragment that expresses mRNA, functional RNA, or specific protein, including regulatory sequences. The term "Native gene" refers to a gene as found in nature. The term "chimeric gene" refers to any gene that contains 1) DNA sequences, including regulatory and coding sequences, that are not found together in nature, or 2) sequences encoding parts of proteins not naturally adjoined, or 3) parts of promoters that are not naturally adjoined. Accordingly, a chimeric gene may comprise regulatory sequences and coding sequences that are derived from different sources, or comprise regulatory sequences and coding sequences derived from the same source, but arranged in a manner different from that found in nature. A "transgene" refers to a gene that has been introduced into the genome by transformation and is stably maintained. Transgenes may include, for example, genes that are either heterologous or homologous to the genes of a particular plant to be transformed. Additionally, transgenes may comprise native genes inserted into a non-native organism, or chimeric genes. The term "endogenous gene" refers to a native gene in its natural location in the genome of an organism. A "foreign" gene refers to a gene not normally found in the host organism but one that is introduced into the organism by gene transfer.

"Expression cassette" as used herein means a DNA sequence capable of directing expression of a particular nucleotide sequence in an appropriate host cell, comprising a promoter operably linked to the nucleotide sequence of interest which is operably linked to termination signals. It also typically comprises sequences required for proper translation of the nucleotide sequence. The coding region usually codes for a protein of interest but may also code for a functional RNA of interest, for example antisense RNA or a nontranslated RNA, in the sense or antisense direction. The expression cassette comprising the nucleotide sequence of interest may be chimeric, meaning that at least one of its components is heterologous with respect to at least one of its other components.

"Intron" refers to an intervening section of DNA which occurs almost exclusively within a eukaryotic gene, but which is not translated to amino acid sequences in the gene product. The introns are removed from the pre-mature mRNA through a process called splicing, which leaves the exons untouched, to form an mRNA. For purposes of the present invention, the definition of the term "intron" includes modifications to the nucleotide sequence of an intron derived from a target gene, provided the modified intron does not significantly reduce the activity of its associated 5' regulatory sequence.

"Exon" refers to a section of DNA which carries the coding sequence for a protein or part of it. Exons are separated by intervening, non-coding sequences (introns). For purposes of the present invention, the definition of the term "exon" includes modifications to the nucleotide sequence of an exon derived from a target gene, provided the modified exon does not significantly reduce the activity of its associated 5' regulatory sequence.

BRIEF DESCRIPTION OF THE FIGURES

FIG. 10 shows an alignment of T6PP protein sequences from Zea mays (SEQ ID NO:540), Oryza sativa (SEQ ID NO:541), Zea mays (SEQ ID NO:542), Oryza sativa (SEQ ID NO:531), Arabidopsis thaliana (SEQ ID NO:543), Zea mays (SEQ ID NO:544), Oryza sativa (SEQ ID NO:545), and Arabidopsis thaliana (SEQ ID NO:546).

DETAILED DESCRIPTION OF THE INVENTION

Figure 1:
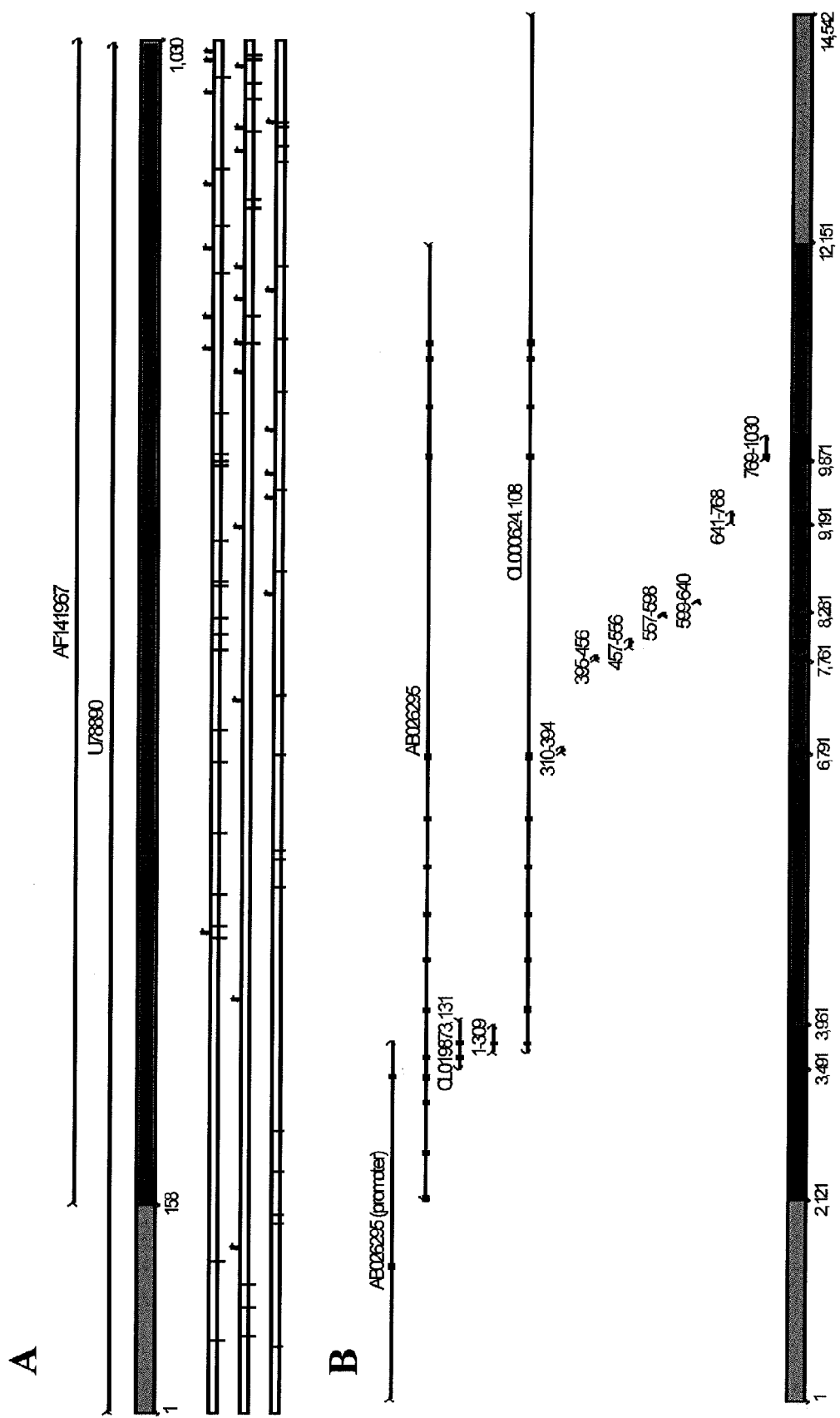
FIGS. 1A and 1B are schematic representations of the OsMADS5 cDNA and of the annotation of the OsMADS5 gDNA with OsMADS5 cDNA sequence.
Figure 2:
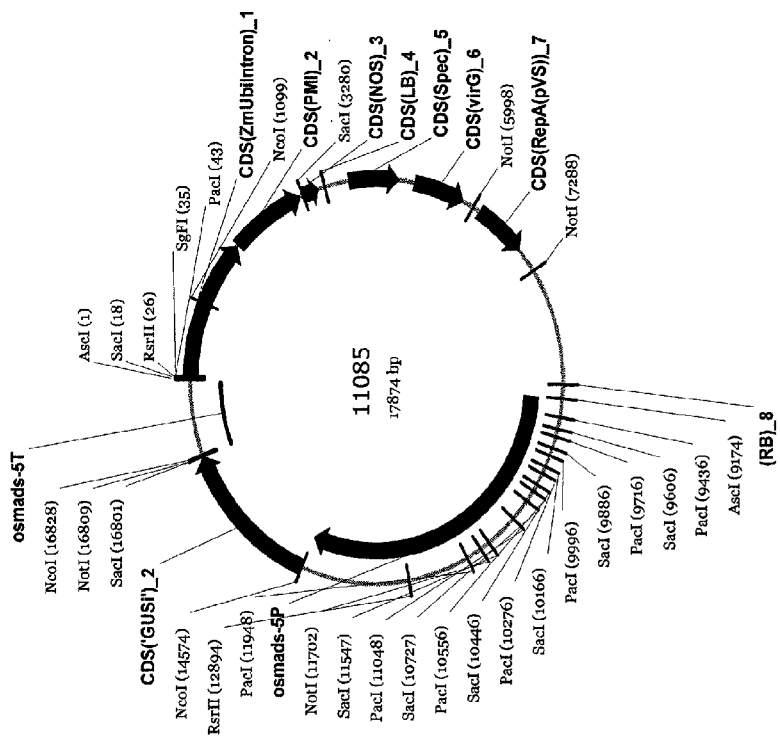
FIG. 2A is a schematic representation of the OsMADS5 assembly vector.
FIG. 2B is a schematic representation of the OsMADS5 binary vector.
Figure 2:
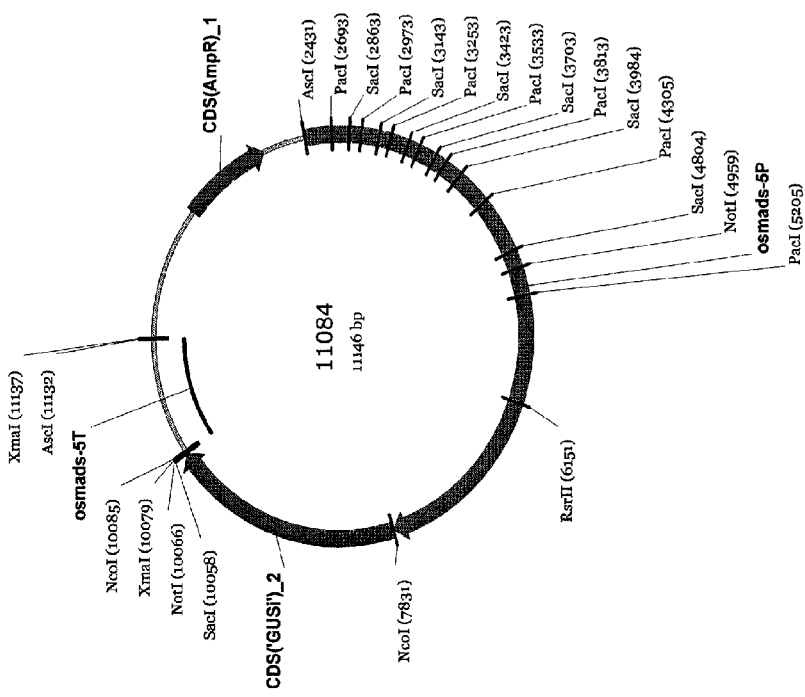

The present invention includes a method for constructing expression cassettes based on identifying a target gene and incorporating into the expression cassettes modified regulatory elements of the selected target gene. For example, regulatory elements from genes that are expressed in roots, stalks, leaves, or reproductive tissues that provide insect resistance, herbicide tolerance, or abiotic stress tolerance are incorporated into expression cassettes for the purpose of producing a transgenic event in a plant that closely mimics the expression profile of the original target gene. Thus, the target gene may be identified from gene expression data.

The present invention is also directed to expression cassettes that incorporate the regulatory mechanisms of target genes of interest to express in plants the products of nucleic acid molecules of interest in a manner that mimics the expression profile of the original target genes.

The present invention further includes expression cassettes that incorporate 5'-MADS gene regulatory sequences to express the products of nucleic acid molecules in plant reproductive tissues, and further includes expression cassettes incorporating both MADS 5'- and 3'-regulatory sequences.

The present invention also includes expression cassettes that incorporate 5'-MADS gene regulatory sequences, and further incorporate a 5'-MADS gene exon.

The present invention also includes expression cassettes that incorporate 5'-MADS gene regulatory sequences, and further incorporates a 5'-MADS gene exon, and a 5'-MADS gene intron.

The present invention further includes expression cassettes that incorporate 5'-MADS gene regulatory sequences, and further incorporates a 5'-MADS gene exon, a 5'-MADS gene intron, and a second exon.

The present invention also includes and further includes expression cassettes incorporating both MADS 5'- and 3'-regulatory sequences, wherein said 3'-regulatory sequence include the 3'-non-translated sequence, and the 3'-nontranscribed sequence.

For purposes of this invention, the definition of the term "3'-non-translated sequence" includes modifications to the nucleotide sequence of a 3'-non-translated sequence derived from a target gene, provided the modified 3'-non-translated sequence does not significantly reduce the activity of its associated 3' regulatory sequence.

For purposes of this invention, the definition of the term "3'-nontranscribed sequence" includes modifications to the nucleotide sequence of a 3'-nontranscribed sequence derived from a target gene, provided the modified 3'-nontranscribed sequence does not significantly reduce the activity of its associated 3' regulatory sequence. The 3'-nontranscribed sequence extends approximately 0.5 to 1.5 kb downstream of the transcription termination site.

The present invention also includes expression cassettes incorporating both MADS 5'- and 3'-regulatory sequences, wherein said 3'-regulatory sequence includes the 3'-non-translated sequence, and the 3'-nontranscribed sequence, and may further include an intron of said MADS gene.

In general MADS genes contribute to the development of plant reproductive structures (De Bodt et al., 2003). For example, the DoMADS3 gene is expressed specifically in pedicel tissue (Yu and Goh, 2000). The genes of the OsMADS gene family were selected for expression cassette development because they encode MADS-transcription factors that are expressed in young rice flowers (Kang and An, 1997). The proteins encoded by genes of the OsMADS gene family are similar to the orchid DoMADS3 gene (GenBank accession AF198176). The present invention recognizes that one method of stabilizing or increasing yield in monocots such as maize is to increase sink strength in reproductive tissue. Thus, transgenic methods for production of plants having increased sink strength in reproductive tissue would benefit from the use of promoters that result in specific expression in a plant's reproductive tissues. The present invention therefore includes the use of OsMADS gene 5'- and 3'-regulatory sequences in expression cassettes to target transgene expression to developing reproductive tissues. The MADS genes from which gene regulatory sequences were identified and utilized according to the present invention encode the following list of MADS proteins (TABLE 1). The MADS proteins are compared by percent identity and similarity to the protein encoded by the DoMADS3 gene.

TABLE 1

| MADS gene | Whole Protein | | | MADS Domain Only | |
|---|---|---|---|---|---|
| | identity | similarity | gaps | identity | similarity |
| AB003322 | 42% | 58% | 0% | 68% | 78% |
| AB003324 | 59% | 74% | 3% | 80% | 95% |
| AB003328 | 48% | 64% | 0% | 77% | 91% |
| AF077760 | 40% | 59% | 2% | 64% | 80% |
| AF095645 | 40% | 61% | 5% | 64% | 90% |
| AF139664 | 50% | 66% | 1% | 78% | 95% |
| AF139665 | 48% | 66% | 0% | 80% | 95% |
| AF141964 | 40% | 60% | 11% | 66% | 86% |
| AF141965 | 51% | 67% | 0% | 84% | 91% |
| AY174093 | 42% | 63% | 0% | 63% | 87% |
| AF204063 | 60% | 72% | 3% | 91% | 98% |
| AF345911 | 50% | 68% | 5% | 80% | 95% |
| AF424549 | 39% | 59% | 2% | 63% | 87% |
| AJ293816 | 35% | 52% | 8% | 65% | 79% |
| AY115556 | 39% | 61% | 1% | 60% | 85% |
| AY177695 | 39% | 58% | 0% | 66% | 87% |
| AY177696 | 38% | 62% | 4% | 61% | 87% |
| AY177698 | 41% | 61% | 3% | 68% | 87% |
| AY177699 | 37% | 59% | 3% | 63% | 78% |
| AY177700 | 41% | 61% | 0% | 66% | 87% |
| AY177702 | 38% | 59% | 5% | 70% | 89% |
| AY224482 | 38% | 59% | 5% | 70% | 89% |
| AY250075 | 42% | 67% | 5% | 64% | 88% |
| L37527 | 37% | 60% | 5% | 63% | 85% |
| L37528 | 45% | 68% | 1% | 84% | 94% |
| U78891 | 62% | 75% | 4% | 94% | 99% |
| U78782 (OsMADS6) | 58% | 69% | 4% | 91% | 99% |
| U78892 (OsMADS8) | 60% | 73% | 6% | 94% | 99% |
| U78890 (OsMADS5) | 57% | 72% | 2% | 92% | 97% |
| AF151693 (OsMADS13) | 46% | 67% | 1% | 84% | 94% |
| AF095646 | 55% | 67% | 6% | 94% | 99% |

The present invention therefore includes an expression cassette for expression of a nucleic acid molecule product primarily in the reproductive tissue of a plant comprising a promoter, a first exon; a first intron, and a second exon of a MADS gene, wherein said promoter, first exon, intron, and second exon are the 5'-regulatory sequence of said expression cassette; wherein said 5'-regulatory sequence is engineered to include a translational initiation codon at approximately the 3'-end of said 5'-regulatory sequence, and not to contain restriction endonuclease sites that hinder manipulation by recombinant DNA methods or additional translation initiation codons upstream of said translation initiation codon; a 3'-regulatory sequence of a MADS gene that does not to contain restriction endonuclease sites that hinder manipulation by recombinant DNA methods; and a nucleic acid molecule operably linked to said 5'-regulatory sequence and said 3'-regulatory sequence.

Recombinant DNA methods require the presence of specific restriction endonuclease sites at the termini of the DNA molecules to be joined. The most efficient practice requires the sites in one molecule complement the sites in the other molecule. For example, a plasmid with SacI and NotI restriction endonuclease sites is required to clone a gene of interest with SacI and Not I restriction endonuclease sites at its termini. Ideally, these sites are unique, that is they should not occur at any other place in either molecule. If these sites occur internally, they hinder manipulation by recombinant DNA methods and should be eliminated. Site-directed mutagenesis is one method of eliminating such sites. Techniques such as partial digestion followed by gel-purification of the appropriately sized fragment will also accomplish this without eliminating the internal restriction endonuclease sites, but are far less efficient and therefore less desirable.

The present invention recognizes that chemical synthesis, that is use of synthetic chemical technology as opposed enzyme-mediated technology, of a polynucleotide molecule can replace or substitute for recombinant DNA methods in the construction of a polynucleotide molecule comprising a specific nucleotide sequence.

The present invention further includes a method for constructing an expression cassette comprising the steps of selecting a target gene based on its expression data or its encoded protein's similarity to a protein encoded by another gene of interest; identifying the open reading frame on said target gene cDNA; identifying the positions of the translational start codon, translational stop codon, the first intron, first exon, second exon, the 3'-untranslated sequence and the 3'-nontranscribed sequence of said target gene gDNA by using the cDNA to annotate the target gene gDNA; incorporating into an expression cassette a 5'-regulatory sequence comprising said promoter, first exon, first intron, and second exon and a 3'-regulatory sequence comprising the 3'-untranslated sequence and the 3'-nontranscribed sequence; and operably linking a nucleic acid molecule to said 5'-regulatory sequence and said 3'-regulatory sequence of said expression cassette, wherein said nucleic acid molecule is expressed in a manner that mimics the expression profile of said target gene of interest.

EXAMPLE 1

Method of Constructing Expression Cassettes Comprising Regulatory Sequences from the MADS Gene Family 1. Identifying target MADS genes.
2. Identifying high quality sequence for both the target's genomic DNA (gDNA) and cDNA.
3. Identifying the target gene's open reading frame on the cDNA. In general this is the longest open reading frame.
4. Using a candidate gene's cDNA sequence to annotate gDNA sequence and marking positions of the translation start codon, translation stop codon, introns, exons, the 5'-untranslated leader and the 3'-untranslated sequence. As is known in the art, marking the translation start codon and the translation stop codon identifies the 5'-regulatory sequence and the 3'-regulatory sequence of the gene. According to the present invention, the promoter, which includes the promoter regulatory sequence, is the sequence that extends approximately 1.5 to 2.5 kb upstream from the translation start codon, wherein the 3'-regulatory sequence of the present invention includes the 3'-untranslated sequence located immediately downstream of the translation stop codon and all or a part of the 3'-nontranscribed sequence, which extends 0.5 to 1.5 kb downstream of the transcription termination site. In one embodiment of the invention, the 5'-regulatory sequence includes the promoter, the first exon, the first intron and the second exon.

By way of example only, FIGS. 1A and 1B illustrates annotating the OsMADS5 gDNA with the OsMADS5 cDNA sequence. The gDNA contigs (AB026295 from GenBank and CL000624.108 (SEQ ID NO. 500) plus CL019873.131 (SEQ ID NO. 521) were aligned with OsMADS5 cDNA sequence (GenBank accession U78890). The cDNA sequence is broken into corresponding exons. The exons are labeled according to cDNA base numbers. Both sequences align precisely and the intervening sequences (introns) are flanked by GT . . . AG borders. Gaps in between exons represent introns.

The AB026295 fragment is a portion of the entire bacterial artificial chromosome (BAC) sequence. The AB026295 (promoter) is an additional fragment from that BAC which defines sequence used for promoter development.

5. Designing expression cassettes that incorporate the following components from a MADS gene(s):
   a. The promoter, a sequence that begins at the translation start codon and extends approximately 1.5 to 2.5 kb upstream of the translation start codon.
   b. The first exon
   c. The first intron
   d. The 5'-most portion of the second exon
   e. The terminus, including the 3'-untranslated sequence and the 3'-nontranscribed sequence, which extends 0.5 to 1.5 kb downstream of the transcription termination site. The terminus can further include an intron.

For simplicity the "5'-regulatory sequence" of the present invention includes components a-d and the "3'-regulatory sequence" of the present invention refers to component e.

6. Amplifying the 5'-regulatory sequence from the appropriate gDNA template by high-fidelity PCR and cloning into a suitable bacterial vector.

The 5'-regulatory sequence from rice genomic DNA (gDNA) is amplified using high-fidelity PCR. A 50 µL reaction mixture contains 100 ng rice gDNA, 200 µM dNTPs (dATP, dCTP, dGTP, TTP), 1 µL 20 µM each of oligonucleotide primers designed to amplify the 5'-regulatory gDNA (Table 2), 1 µL 10× Expand High Fidelity buffer and 1 µL Expand High Fidelity polymerase (Roche Diagnostics, Cat. No. 1 759 078). The thermocycling program is 95° C. for 2 minutes followed by 40 cycles of (94° C. for 15 seconds, 68° C. for 7.5 minutes) followed by 68° C. for 10 minutes. The 5'-regulatory gDNA product is cloned with the TOPO XL PCR cloning kit (Invitrogen, Cat. No.K4750-20). pCR-XL-TOPO-5'-regulatory-gDNA is identified by digesting 5 µL pCR-XL-TOPO-5'-regulatory-gDNA miniprep DNA (prepared using the QIAprep Spin Miniprep procedure from Qiagen, Cat. No. 27106) with EcoRI (New England Biolabs) in a 20 µL reaction containing 2 µg BSA and 2 µL 10× EcoRI restriction endonuclease buffer (New England Biolabs). The reaction is incubated at 37° C. for 2 hours and the pCR-XL-TOPO-5'-regulatory-gDNA (EcoRI) products are resolved on 1% TAE agarose. The pCR-XL-TOPO-5'-regulatory-gDNA clone is sequenced using the ABI PRISM dye terminator cycle sequencing kit (Perkin Elmer).

7. Amplifying the "3'-regulatory sequence" from the appropriate gDNA template by high-fidelity PCR and clone into a suitable bacterial vector.

The 3'-regulatory sequence from rice gDNA is amplified using high-fidelity PCR. The 50 µL reaction mixture consists of 100 ng rice gDNA, 200 µM dNTPs, 1 µL 20 µM each of the oligonucleotide primers designed to amplify the 3'-regulatory gDNA (Table 2), 1 µL 10× Expand High Fidelity buffer and 1 µL Expand High Fidelity polymerase. The thermocycling program is 95° C. for 2 minutes followed by 40 cycles of (94° C. for 15 seconds, 68° C. for 7.5 minutes) followed by 68° C. for 10 minutes. The 3'-regulatory gDNA product is cloned with the TOPO XL PCR cloning kit (Invitrogen, Cat. No.K4750-20) following manufactures' instructions. The pCR-XL-TOPO-3'-regulatory-gDNA is identified by digesting 5 µL pCR-XL-TOPO-3'-regulatory-gDNA miniprep DNA with EcoRI in a 20 µL reaction containing 2 µg BSA and 2 µL 10× EcoRI restriction endonuclease buffer. The reaction is incubated at 37° C. for 2 hours and the pCR-XL-TOPO-3'-regulatory-gDNA (EcoRI) products are resolved on 1% TAE agarose. The pCR-XL-TOPO-3'-regulatory-gDNA clone is then sequenced.

8. Assembling the 5'-regulatory sequence and 3'-regulatory sequence in any bacterial plasmid.

The expression cassettes of the present invention were assembled in the vector pNOV6901, also known as the "Assembly Vector". This vector contains the coding sequence for GUS reporter gene (which is disrupted by an intron to prevent bacterial expression) flanked at its 5'- and 3'-termini by unique restriction sites (polylinkers) to facilitate recombinant DNA procedures. Any number of other vectors may be used as is known to those persons skilled in the art.

9. Incorporating restriction sites in the expression cassettes, as necessary, to facilitate recombinant DNA procedures.

The "engineered" translation initiation codon, below, is the ATG in the NcoI restriction site (CCATGG). If there are any NcoI restriction sites in the "expression cassette 5'-regulatory sequence" they must be eliminated by mutagenesis. Likewise, restriction sites that are used to assemble the expression cassette must be eliminated by mutagenesis. Incorporation of the first intron in the "expression cassette 5'-regulatory sequence" requires the sequence be modified to avoid creating fusions between native coding sequence, which is normally translated into protein encoded by target gene, and the "gene of interest" (nucleic acid molecule) to be driven by the expression cassette. This is accomplished by any of a number of mutagenic procedures, including the procedure performed by the Stratagene QuikChange Multi Site-Directed Mutagenesis Kit (Cat. No. 200513). Modifications to the expression cassette 5'-regulatory sequence include:
   a. Modifying the target gene's natural translation initiation codon so that the target gene's protein coding sequence is silent.
   b. Modifying any other translation initiation codons that exist in the sequence between the "silenced" translation initiation codon and the "engineered" translation initiation codon to insure such codons are not operable.
   c. Modifying any NcoI sites in the 5'-regulatory sequence.
   d. Modifying restriction endonuclease sites, as necessary, to facilitate expression cassette assembly.

In this embodiment of the invention, the procedure does not eliminate nucleotides. Rather, it modifies them to preserve the length of the 5'-regulatory sequence in the expression cassette, yet still silencing the candidate gene's protein coding sequence. However, it is contemplated that one or more of the nucleotides could be eliminated to silence undesired protein expression, provided that 5'- and 3'-regulatory sequences of the cassette continue to enhance expression of the candidate gene in plant reproductive tissue. Furthermore, those skilled in the art do not consider it unreasonable to alter the sequence of nucleotides in a polynucleotide molecule comprising a regulatory sequence so long as the modified regulatory sequence retains a majority of the activity associated with the original regulatory sequence.

Table 2 lists the primers designed to accomplish this task for each 5'-regulatory sequence derived from the MADs gene family. The Stratagene QuikChange Multi Site-Directed Mutagenesis Kit uses each gene's pCR-XL-TOPO-5'-regulatory-gDNA clone as a template and the primers listed to mutagenize that clone according to the present invention. The primers must contain a 5'-phosphate to work. Furthermore, alterations may require more than one round of mutagenesis. The modified pCR-XL-TOPO-5'-regulatory clone is sequenced using the ABI PRISM dye terminator cycle sequencing kit (Perkin Elmer).

10. Modifying, in some cases, the 3'-regulatory sequence to eliminate restriction endonuclease sites to facilitate recombinant DNA procedures. The "engineered" translation initiation codon is the ATG in the NcoI restriction site (CCATGG).

If there are any NcoI restriction sites in the "expression cassette 3'-regulatory sequence" they must be eliminated by mutagenesis. Again, this is accomplished any of a number of mutagenic procedures. The present invention therefore includes:

a. Modifying any NcoI sites in the 3'-regulatory sequence.
b. Modifying restriction endonuclease sites, as necessary, to facilitate expression cassette assembly.

In this embodiment of the present invention, the procedure does not eliminate nucleotides. Rather, it modifies them to preserve the length of the 3'-regulatory sequence in the expression cassette. However, it is contemplated that one or more of the nucleotides could be eliminated to silence undesired protein expression, provided that 5'- and 3'-regulatory sequences of the cassette continue to enhance expression of the candidate gene in plant reproductive tissue. Furthermore, those skilled in the art do not consider it unreasonable to alter the sequence of nucleotides in a polynucleotide molecule comprising a regulatory sequence so long as the modified regulatory sequence retains a majority of the activity associated with the original regulatory sequence. Table 2 lists the primers designed to accomplish this task for each 3'-regulatory sequence derived from the MADS gene family. Each gene's pCR-XL-TOPO-3'-regulatory-gDNA clone is used as a template and the primers listed are used to mutagenize these clones. The modified pCR-XL-TOPO-3'-regulatory clones are sequenced.

11. Cloning the 3'-regulatory sequence into pNOV6901, using PCR with the modified pCR-XL-TOPO-3'-regulatory clone as template and the appropriate primer set disclosed in Table 2.

These primers are a 5'-oligonucleotide primer that introduces unique restriction site from the GUS 3'-terminal polylinker in pNOV6901 and 3'-oligonucleotide primer that introduces a rare cutting restriction site (either AscI, PacI, SgfI or RsrII) followed by a restriction endonuclease site unique to the 3'-terminal polylinker. In Table 2, these primers are listed as "primers to clone 3'-regulatory sequence in pNOV6901".

High-fidelity PCR is used to amplify the 3'-regulatory sequence from the modified pCR-XL-TOPO-3'-regulatory clone. A 50 µL reaction mixture consists of 1 µL miniprep DNA, 200 µM dNTPs, 1 µL each of 20 µM oligonucleotide primers (Table 2), 5 µL 10× Cloned PFU buffer and 2.5 Units of Pfuturbo DNA polymerase (Stratagene, Cat. No. 600252). The thermocycling program was 95° C. for 30 seconds then 40 cycles of (95° C. for 10 seconds, 50° C. for 60 seconds, 72° C. for 6 minutes) then 72° C. for 10 minutes. The amplified 3'-regulatory sequence DNA fragment is recovered using the QIAquick PCR purification kit (Qiagen, Cat. No. 28106). The recovered 3'-regulatory sequence DNA fragment is precipitated with 20 µg glycogen, 0.3 M $CH_2COONa$ (pH 5.2) and 2.5 volumes ethanol at −20° C. for more than 2 hours. The 3'-regulatory sequence DNA fragment is recovered by micro centrifugation, washed with 70% ethanol, dried under vacuum and resuspend in 14 µL $ddH_2O$. The 3'-regulatory sequence DNA fragment is digested in a 20 µL reaction containing 2 µg BSA, 2 µL of the appropriate 10× restriction endonuclease buffer and 2 µL of the appropriate restriction endonuclease(s). The reaction is incubated at 37° C. for more than 6 hours. The digested 3'-regulatory sequence DNA products are resolved on 1.0% TAE agarose and the appropriate 3'-regulatory sequence (digested) band is excised. The 3'-regulatory sequence (digested) DNA is extracted and recovered using the QIAquick Gel extraction kit (Qiagen, Cat. No. 28704). The recovered 3'-regulatory sequence (digested) DNA is ethanol precipitated with glycogen carrier. The 3'-regulatory sequence (digested) DNA fragment is recovered by micro centrifugation, washed with 70% ethanol, dried under vacuum and resuspended in 5 µL $ddH_2O$.

2 µg of pNOV6901 miniprep DNA is digested in a 20 µL reaction mixture containing 2 µg BSA, 2 µL of the appropriate 10× restriction endonuclease buffer (used to generate the 3'-gene regulatory sequence,) and 2 µL of the appropriate restriction endonuclease (used to generate the 3'-gene regulatory sequence). The reaction mixture is incubated at 37° C. for more than 6 hours, then at 70° C. for 20 minutes. Then 1 µL of the appropriate 10× restriction endonuclease buffer, 1 µL 1 Unit/µL calf-intestinal alkaline phosphatase (CIP-New England Biolabs) and 8 µL $ddH_2O$ is added to the reaction mixture and incubated at 37° C. for 30 minutes. The pNOV6901 (digested/CIP) DNA is resolved on 1.0% TAE agarose and the 4.7 kb pNOV6901 (digested/CIP) band is excised. The pNOV6901 (digested/CIP) DNA is extracted and recovered using the QIAquick Gel extraction kit (Qiagen, Cat. No. 28704). The recovered pNOV6901 (digested/CIP) DNA is ethanol precipitated with glycogen carrier. The pNOV6901 (digested/CIP) DNA is recovered by micro centrifugation, washed with 70% ethanol, and dried under vacuum and resuspend in 5 µL $ddH_2O$.

4.0 µL 3'-regulatory sequence (digested) is ligated to 4.0 µL pNOV6901 (digested/CIP) in a 10 µL ligation mixture containing 1 µL 10× T4 DNA ligase buffer and 1 µL T4 DNA ligase (400 Units/µL-New England Biolabs). The ligation mixture is incubated for more than 8 hours at 16° C. 5.0 µL of ligation mixture is transformed into 50 µL Top10 competent cells (Invitrogen, Cat. No. C4040-03). The pNOV6901-3'-regulatory-sequence recombinants are verified by digesting 2 µL pNOV6901-3'-regulatory-sequence miniprep DNA with 1 µL of the appropriate restriction endonuclease in 10 µL reactions containing 1 µg BSA and 1 µL of the appropriate 10× restriction endonuclease buffer. Digests are incubated at 37° C. for 2 hours then resolved on 1% TAE agarose. The positive pNOV6901-3'-regulatory-sequence recombinants are sequenced.

12. Cloning the 5'-regulatory sequence into pNOV6901-3'-regulatory-sequence, using PCR with the modified pCR-XL-TOPO-5'-regulatory clone as template and the appropriate primer set disclosed in Table 2.

These primers are a 5'-oligonucleotide primer that introduces the same rare cutting restriction site used for the 3'-regulatory sequence preceded by a unique restriction endonuclease site in the 5'-terminal polylinker of pNOV6901 and a 3'-oligonucleotide primer that introduces an NcoI site preceded by a Kozak sequence (CCACCATGG) at the "engineered" translation initiation codon. Table 2 lists these primers as "primers to clone 5'-regulatory sequence in pNOV6901".

High-fidelity PCR is used to amplify the 5'-regulatory sequence from the modified pCR-XL-TOPO-5'-regulatory clone. A 50 µL reaction mixture consists of 1 µL miniprep DNA, 200 µM dNTPs, 1 µL each of 20 µM oligonucleotide primers (Table 2), 5 µL 10× Cloned PFU buffer and 2.5 Units of Pfuturbo DNA polymerase (Stratagene, Cat. No. 600252). The thermocycling program was 95° C. for 30 seconds then 40 cycles of (95° C. for 10 seconds, 50° C. for 60 seconds, 72° C. for 6 minutes) then 72° C. for 10 minutes. The amplified 5'-regulatory sequence DNA fragment is recovered using the QIAquick PCR purification kit. The recovered 5'-regulatory sequence DNA fragment is ethanol precipitated with glycogen carrier. The 5'-regulatory sequence DNA fragment is recovered by micro centrifugation, washed with 70% ethanol, dried under vacuum and resuspend in 14 µL $ddH_2O$. The 5'-regulatory sequence DNA fragment is digested in a 20 µL reaction containing 2 µg BSA, 2 µL of the appropriate 10× restriction endonuclease buffer and 2 µL of the appropriate restriction endonuclease(s). The reaction is incubated at 37° C. for more than 6 hours. The digested 5'-regulatory sequence DNA products are resolved on 1.0% TAE agarose and the appropriate 5'-regulatory sequence (digested) band is excised. The 5'-regulatory sequence (digested) DNA is extracted and recovered using the QIAquick Gel extraction kit (Qiagen, Cat. No. 28704). The recovered 5'-regulatory sequence (digested) DNA is ethanol precipitated with glycogen carrier. The 5'-regulatory sequence (digested) DNA fragment is recovered by micro centrifugation, washed with 70% ethanol, dried under vacuum and resuspended in 5 µL ddH₂O.

2 µg of the pNOV6901-3'-regulatory-sequence miniprep DNA is digested in a 20 µL reaction containing 2 µg BSA, 2 µL of the appropriate 10× restriction endonuclease buffer and 2 µL of the appropriate restriction endonuclease. The reaction is incubated at 37° C. for more than 6 hours, then at 70° C. for 20 minutes. Then 1 µL of the appropriate 10× restriction endonuclease buffer, 1 µL 1 Unit/µL CIP and 8 µL ddH₂O are added to the reaction and it is further incubated at 37° C. for 30 minutes. The pNOV6901-3'-regulatory-sequence (digested/CIP) DNA is resolved on 1.0% TAE agarose and the pNOV6901-3'-regulatory-sequence (digested/CIP) band is excised. The pNOV6901-3'-regulatory-sequence (digested/CIP) DNA is extracted and recovered. The recovered pNOV6901-3'-regulatory-sequence (digested/CIP) DNA is ethanol precipitated with glycogen carrier. The pNOV6901-3'-regulatory-sequence (digested/CIP) DNA is recovered by micro centrifugation, washed with 70% ethanol, dried under vacuum and resuspended in 5 µL ddH₂O.

4.0 µL of the 5'-regulatory sequence (digested) is ligated to 4.0 µL pNOV6901-3'-regulatory-sequence (digested/CIP) in a 10 µL ligation mixture containing 1 µL 10× T4 DNA ligase buffer and 1 µL T4 DNA ligase (400 Units/µL). The ligation mixture is incubated for more than 8 hours at 16° C. 5.0 µL of ligation mixture is transformed into 50 µL Top10 competent cells. The pNOV6901-3'/5'-regulatory-sequence recombinants are verified by digesting 2 µL pNOV6901-3'/5'-regulatory-sequence miniprep DNA with 1 µL of the appropriate restriction endonuclease in 10 µL reaction mixtures containing 1 µg BSA and 1 µL of the appropriate 10× restriction endonuclease buffer. Digests are incubated at 37° C. for 2 hours then pNOV6901-3'/5'-regulatory-sequence (digested) DNA is resolved on 1% TAE agarose. The positive pNOV6901-3'/5'-regulatory-sequence recombinants are sequenced.

The expression cassette of the present invention includes a GUS reporter construct in the Assembly Vector. It is flanked by the engineered, rare-cutting restriction site. In this embodiment of the present invention the GUS reporter gene can be replaced with any gene of interest using methods known to those individuals skilled in the art.

13. The expression cassette can now be mobilized into the *agrobacterium* binary vector pNOV6900, by digesting the assembly vector with the rare-cutting enzyme and purifying the cassette DNA.

2 µg pNOV6900 is digested in a 20 µL reaction mixture containing 2 µg BSA, 2 µL of the appropriate 10× restriction endonuclease buffer and 2 µL of the appropriate restriction endonuclease. The reaction mixture is incubated at 37° C. for more than 6 hours, then at 70° C. for 20 minutes. Then 1 µL of the appropriate 10× restriction endonuclease buffer, 1 µL 1 Unit/µL CIP and 8 µL ddH₂O are added to the reaction and it is further incubated at 37° C. for 30 minutes. 2 µg of the pNOV6901-3'/5'-regulatory-sequence miniprep DNA is digested in a 20 µL reaction containing 2 µg BSA, 2 µL of the same 10× restriction endonuclease buffer used for pNOV6900 and 2 µL of the same restriction endonuclease used for pNOV6900. The reaction is incubated at 37° C. for more than 6 hours.

The digested plasmid DNA, pNOV6900 (digested/CIP) and pNOV6901-3'/5'-regulatory-sequence (digested) are resolved on 1.0% TAE agarose and the 9.2 kb pNOV6900 (digested/CIP) and the appropriate pNOV6901-3'/5'-regulatory-sequence (digested) bands are excised. The pNOV6900 (digested/CIP) and the pNOV6901-3'/5'-regulatory-sequence (digested) DNAs are extracted and recovered. The recovered pNOV6900 (digested/CIP) and the pNOV6901-3'/5'-regulatory-sequence (digested) DNAs are ethanol precipitated with glycogen. The pNOV6900 (digested/CIP) and the pNOV6901-3'/5'-regulatory-sequence (digested) DNA fragments are recovered by micro centrifugation, washed with 70% ethanol, dried under vacuum and resuspended each in 5 µL ddH₂O.

4.0 µL of the pNOV6900 (digested/CIP) is ligated to 4.0 µL pNOV6901-3'/5'-regulatory-sequence (digested) in a 10 µL ligation mixture containing 1 µL 10× T4 DNA ligase buffer and 1 µL T4 DNA ligase (400 U/µL). The ligation mixture is incubated for more than 8 hours at 16° C. 5.0 µL of ligation mixture is transformed into 50 µL Top10 competent cells. The pNOV6900-pNOV6901-3'/5'-regulatory-sequence recombinants are verified by digesting 7.5 µL pNOV6900-pNOV6901-3'/5'-regulatory-sequence miniprep DNA with 1.0 µL NcoI in 10 µL reaction mixtures containing 1 µg BSA and 1 µL 10× restriction endonuclease buffer 4 (New England Biolabs). Digests are incubated at 37° C. for 2 hours then resolved on 1% TAE agarose. The junction sequence of positive pNOV6900-pNOV6901-3'/5'-regulatory-sequence recombinants is verified.

14. The expression cassette can now be transformed into *agrobacterium* and then transformed into plants in accordance with methods known to those persons skilled in the art.

TABLE 2

Primers for constructing expression cassettes comprising regulatory sequences from the MADS gene family

| target gene | name | sequence |
|---|---|---|
| primers to clone 5'-regulatory sequence | | |
| AB003322 | AB003322-1(SEQ. ID No. 133) | 5'-CGTTGCCCAGCGAGGAGCATGCGTAAAATC-3' |
| | AB003322-2(SEQ. ID No. 134) | 5'-GATTTCATTCATACTGTCCAACAGAAGGCA-3' |
| AB003324 | AB003324-1(SEQ. ID No. 145) | 5'-TCTAAATAGGGCCCAACATACTCA-3' |
| | AB003324-2(SEQ. ID No. 146) | 5'-TCAAGCGTCTTAAGCATGCTGAAATATGA-3' |

TABLE 2-continued

Primers for constructing expression cassettes comprising regulatory sequences from the MADS gene family

| | | |
|---|---|---|
| AB003328 | AB003328-1(SEQ. ID No. 158) | 5'-AACAAAACCAATAATCTCCAATGCCC-3' |
| | AB003328-2(SEQ. ID No. 158) | 5'-CATCTTCGATCGCCGATGAACCAACC-3' |
| AB077760 | AB077760-1(SEQ. ID No. 167) | 5'-ATTCGTTGGGGGTGACATGACTAGTC-3' |
| | AB077760-2(SEQ. ID No. 168) | 5'-CAAAGATCCCCTTGATGCTGCAGCAG-3' |
| AB095645 | AB095645-1(SEQ. ID No. 179) | 5'-CTCGTCGCCGTCGTTGGCTCGGCGT-3' |
| | AB095645-2(SEQ. ID No. 180) | 5'-CAAGATTCTTGATAGCCTTATACATG-3' |
| AF139664 | AF139664-1(SEQ. ID No. 193) | 5'-TGCATCCTTACAAAGAGACAGATAGATC-3' |
| | AF139664-2(SEQ. ID No. 194) | 5'-CAAGGATTTTGTCCATACTGTGAAAAATG-3' |
| AF139665 | AF139665-1(SEQ. ID No. 207) | 5'-ACCTGGGGTTTGGAAATGGGGAGCG-3' |
| | AF139665-2(SEQ. ID No. 208) | 5'-CAAGGATCCCTTCCATACTACAGAAGAAG-3' |
| AF141964 | AF141964-1(SEQ. ID No. 218) | 5'-AAAACACTGATTAAAGGGTTGTTGAAAGGAAAACACC-3' |
| | AF141964-2(SEQ. ID No. 219) | 5'-CATAGGTACCTTCAATGCTGAAAAAGAAAACAAGGCA-3' |
| AF141965 | AF141965-1(SEQ. ID No. 232) | 5'-TGTTTCTCGATTAGGCTACAAGTTAAC-3' |
| | AF141965-2(SEQ. ID No. 233) | 5'-GATGGTTTTCTGTAGGCTGCAGAACAG-3' |
| AF174093 | AF174093-1(SEQ. ID No. 246) | 5'-AAAATTCACAAGTATAATTCGTCAC-3' |
| | AF174093-2(SEQ. ID No. 247) | 5'-CAGCTCCATCAAGCTTAACAAAGCA-3' |
| AF204063 | AF204063-1(SEQ. ID No. 258) | 5'-ACAAATTTGTTGTACCACCTACCTAGGGGT-3' |
| | AF204063-2(SEQ. ID No. 259) | 5'-CAAGGTTTTGTACATGCTGGAAGTGAA-3' |
| AF345911 | AF345911-1(SEQ. ID No. 271) | 5'-GAAAATCTCAAGGTTTCGAAAACGAC-3' |
| | AF345911-2(SEQ. ID No. 272) | 5'-CAAGGATTTTGTCCATCCTGCAGGGAAAAC-3' |
| AF424549 | AF424549-1(SEQ. ID No. 283) | 5'-TACAAAGTGCTGGAAGTGATAGTATGT-3' |
| | AF424549-2(SEQ. ID No. 284) | 5'-GATCCCCTTGATGCTGCAGCAGGATGCA-3' |
| J293816 | AJ293816-1(SEQ. ID No. 295) | 5'-CAAACATTTTAAACTTTAACCATTAATAG-3' |
| | AJ293816-2(SEQ. ID No. 296) | 5'-CAATAATCTGTTCCATGCTTCATCAATG-3' |
| Y115556 | AY115556-1(SEQ. ID No. 305) | 5'-GATATAAAAACCTACTTTATGTTCATG-3' |
| | AY115556-2(SEQ. ID No. 306) | 5'-CAGCTCCTCCATGGTTCTGTTCAAAGAAATC-3' |
| Y177695 | AY177695-1(SEQ. ID No. 316) | 5'-TCAGTCCATCATTTCGTCTACAACTAA-3' |
| | AY177695-2(SEQ. ID No. 317) | 5'-TATTATTGATTTCATGCTAACAAAAAG-3' |
| Y177696 | AY177696-1(SEQ. ID No. 330) | 5'-CAAGCAAAGAAACAAATTTCGCAATTAG-3' |
| | AY177696-2(SEQ. ID No. 331) | 5'-ATAACTGACTTCATGCTGCATATTTGCA-3' |
| Y177698 | AY177698-1(SEQ. ID No. 342) | 5'-AAGATTTGAACTACTGCCTTGTCTTC-3' |
| | AY177698-2(SEQ. ID No. 343) | 5'-CAAAGATATTTGCAATCCTGCCAAAAG-3' |
| Y177699 | AY177699-1(SEQ. ID No. 356) | 5'-TCCGGTCGGCCCTCGTCCTCCCCGT-3' |
| | AY177699-2(SEQ. ID No. 357) | 5'-CAAACTCCCTCACGCTGCGCCAAGAAAG-3' |
| AY177700 | AY177700-1(SEQ. ID No. 366) | 5'-ATAAGTATTTCAGAAAGCTGAAGTTGA-3' |
| | AY177700-2(SEQ. ID No. 367) | 5'-CAAGTTATGCATATTTCTTGCATTTTG-3' |
| Y177702 | AY177702-1(SEQ. ID No. 379) | 5'-TCTTTTCGCAAACTAAACAAGGCCT-3' |
| | AY177702-2(SEQ. ID No. 380) | 5'-CACAGTTTTCATGCTAGCATGCAAGTAAAG-3' |
| Y224482 | AY224482-1(SEQ. ID No. 392) | 5'-TCTTTTCGCAAACTAAACAAGGCCTTAACA-3' |
| | AY224482-2(SEQ. ID No. 393) | 5'-TATCACAGTTTTCATGCTAGCATGCAAGT-3' |
| Y250075 | AY250075-1(SEQ. ID No. 405) | 5'-GAAATGGTTTCATTTGGGACAAGTTATTG-3' |
| | AY250075-2(SEQ. ID No. 406) | 5'-CAAGGATTCGCTCCATACTATCAATAAAATATG-3' |
| L37527 | L37527-1~~(SEQ. ID No. 419) | 5'-GCCAAGAGAGCCCCCTTGCTGCTGGT-3' |
| | L37527-2~~(SEQ. ID No. 420) | 5'-CAAGATCCTTGACAGCCTAAAACGCCA-3' |
| L37528 | L37528-1~~(SEQ. ID No. 432) | 5'-ACCACCTCAATCTCCACTGTTTGATTG-3' |
| | L37528-2~~(SEQ. ID No. 433) | 5'-CAGCTCAGATCGGTCTGGACACAAAC-3' |
| U78891 | U78891-1~~(SEQ. ID No. 443) | 5'-TCTTCTTCTTGCCTTCATTTGAGTTAATTACA-3' |
| | U78891-2~~(SEQ. ID No. 444) | 5'-CAAGCGTTTTAGTCATGCTACAAAGTTC-3' |
| | AF095646-1(SEQ ID No. 508) | 5'-TGTTGCATGCATGCGTACTGGTGATGGCCGCA-3' |
| | AF095646-2(SEQ ID No. 509) | 5'-AATGTCTTGTTTATTCTGCAAACAAAAATAGG-3' |

TABLE 2-continued

Primers for constructing expression cassettes comprising regulatory sequences from the MADS gene family

| name | sequence |
|---|---|
| primers to clone 3'-regulatory sequence | |
| AB003322-3(SEQ. ID No. 135) | 5'-TAACTGAAAGGAAAAAAAAAGCATCCTTGC-3' |
| AB003322-4(SEQ. ID No. 136) | 5'-GAATAAATCTGGCAACTGAAATCCAACCAT-3' |
| AB003324-3(SEQ. ID No. 147) | 5'-CTAGCTAGCTAGCTACCGTTTCAGCTTC-3' |
| AB003324-4(SEQ. ID No. 148) | 5'-TGGAGATCGACCACAATTAAATTCGT-3' |
| AB003328-3(SEQ. ID No. 160) | 5'-TAAGTAACAGGCCAGGAATAAGCTGG-3' |
| AB003328-4(SEQ. ID No. 161) | 5'-ATTGCCGGGCTATAGCCTTTCTCCCT-3' |
| AB077760-3(SEQ. ID No. 169) | 5'-TGATATATCATCGCCGCCGCCGCCG-3' |
| AB077760-4(SEQ. ID No. 170) | 5'-CCGTGGTACTGAAATCGAAAAAAGAAATG-3' |
| AB095645-3(SEQ. ID No. 181) | 5'-TAAGCTGCTAGGTTGCCCCGCCACT-3' |
| AB095645-4(SEQ. ID No. 182) | 5'-GCACGGCTACCTCTCGCCGGAGTACG-3' |
| AF139664-3(SEQ. ID No. 195) | 5'-TAAGGAGGCTTCAGATCCATACCAG-3' |
| AF139664-4(SEQ. ID No. 196) | 5'-GGATAAACATTGTGAAGCAACATTTC-3' |
| AF139665-3(SEQ. ID No. 209) | 5'-TGAAGGCATCTGTTGATCTCAAACGTC-3' |
| AF139665-4(SEQ. ID No. 210) | 5'-ATGAACTCCACCTCGGGAACTCAGCCT-3' |
| AF141964-3(SEQ. ID No. 220) | 5'-TGAGCAGGAAGCACAGGTGTCCTGT-3' |
| AF141964-4(SEQ. ID No. 221) | 5'-ATGAGATACAATCTAGTACAACGAAT-3' |
| AF141965-3(SEQ. ID No. 234) | 5'-TGAAGAAGGCCAGCCACAGCAACAGCTG-3' |
| AF141965-4(SEQ. ID No. 235) | 5'-CCTTATCGAATATTCAAATCTCGATG-3' |
| AF174093-3(SEQ. ID No. 248) | 5'-TGACTTCCTGGAAGCAGTAGGAAC-3' |
| AF174093-4(SEQ. ID No. 249) | 5'-CCCCTTCTCCTCCTCCGGGAAGAAG-3' |
| AF204063-3(SEQ. ID No. 260) | 5'-TGATGTGTGTGTTCAGTTCAGGCTT-3' |
| AF204063-4(SEQ. ID No. 261) | 5'-CTGCATATACTTGCAACATTGCAATTTTA-3' |
| AF345911-3(SEQ. ID No. 273) | 5'-TAAGATGATCATCGTCGTCGTCGTCG-3' |
| AF345911-4(SEQ. ID No. 274) | 5'-TTGACTTAAATGGCAAGATAAATTAGATATAG-3' |
| AF424549-3(SEQ. ID No. 285) | 5'-TGAGATATCATCGCCGCCGCCGCCGCCG-3' |
| AF424549-4(SEQ. ID No. 286) | 5'-TTTTATTATCTTGGCGAGGCCCAAGCACCTTTG-3' |
| AJ293816-3(SEQ. ID No. 297) | 5'-TGATGGCTGGAAACTAAAACTGAGAGGA-3' |
| AJ293816-4(SEQ. ID No. 298) | 5'-TTTGAAACATTTCGGCCCTGGCTCTCCT-3' |
| AY115556-3(SEQ. ID No. 307) | 5'-TAACACTAATAATGGCCTGGGGATAC-3' |
| AY115556-4(SEQ. ID No. 308) | 5'-AACTTTTGCACGAATGATTAAATTGCAT-3' |
| AY177695-3(SEQ. ID No. 318) | 5'-TAACACATGATCAAGTGTTAAAAACAG-3' |
| AY177695-4(SEQ. ID No. 319) | 5'-GGCTCGGTCAAACCAGCGTGGTGAGCT-3' |
| AY177696-3(SEQ. ID No. 332) | 5'-TGACCAGAAAAACATTGTTTTGCTAC-3' |
| AY177696-4(SEQ. ID No. 333) | 5'-TTTGGGATTGGACTGCATCCCAGGAA-3' |
| AY177698-3(SEQ. ID No. 344) | 5'-TGATTGCCCTCTTTCCATCCCAATAGG-3' |
| AY177698-4(SEQ. ID No. 345) | 5'-GTTAACCTAAAAGAAATATTGTTCAG-3' |
| AY177699-3(SEQ. ID No. 358) | 5'-TAGAAACAGATGGACGCTTGACGTTTCA-3' |
| AY177699-4(SEQ. ID No. 359) | 5'-AGGCTTGGTGCAAGGATACGAAATCTTG-3' |
| AY177700-3(SEQ. ID No. 368) | 5'-TAGCCGTCAAAGGACCTTGGTCAATTC-3' |
| AY177700-4(SEQ. ID No. 369) | 5'-TAATTTTACTAGTACTTTTACTTTGAC-3' |
| AY177702-3(SEQ. ID No. 381) | 5'-TAAGACTATGCCGTACAAGCTGGACGA-3' |
| AY177702-4(SEQ. ID No. 382) | 5'-CCGTGGTTGTCACAGAAGACCAATCTATAC-3' |
| AY224482-3(SEQ. ID No. 394) | 5'-TAAGACTATGCCGTACAAGCTGGACGA-3' |
| AY224482-4(SEQ. ID No. 395) | 5'-CCGTGGTTGTCACAGAAGACCAATCTATAC-3' |
| AY250075-3(SEQ. ID No. 407) | 5'-TAGAAGATGTTCAGATGAAATGGTCCCT-3' |
| AY250075-4(SEQ. ID No. 408) | 5'-AAAAAAATCACCGGCGTCAAATATTTAGGGA-3' |
| L37527-3~~(SEQ. ID No. 421) | 5'-TAGGCTGCTGAGCACTGCCAATTTG-3' |
| L37527-4~~(SEQ. ID No. 422) | 5'-TGCTGGTGCTCGAGGTGCTGAGCGCG-3' |

TABLE 2-continued

Primers for constructing expression cassettes comprising regulatory sequences from the MADS gene family

| | |
|---|---|
| L37528-3~~(SEQ. ID No. 434) | 5'-TAGTTTTGGTGTAGACACCGTACGTAC-3' |
| L37528-4~~(SEQ. ID No. 435) | 5'-TGAAAGCTACATTTTAGCCTTGTATTTG-3' |
| U78891-3~~(SEQ. ID No. 445) | 5'-TGAACAGTGCGTGCATGAACACCTACATG-3' |
| U78891-4~~(SEQ. ID No. 446) | 5'-GATGTTTTTTTTGTCTTTTGATGCAAGGCC-3' |
| AF095646-3(SEQ. ID No. 510) | 5'-TGAAGTCCAAGCTTGCTAATAAAAACGCTG-3' |
| AF095646-4(SEQ. ID No. 511) | 5'-AAGGGTAGGGCTGCACGAAATGC-3' | primers to mutagenize 5'-regulatory sequence

| | |
|---|---|
| AB003322-5(SEQ. ID No. 137) | 5'-CGCGCGGCGGCGATCGCGCGGGAGAGGCGG-3' |
| AB003322-6(SEQ. ID No. 138) | 5'-CTTCTGTTGGACAGTATCAATGAAATC-3' |
| AB003322-7(SEQ. ID No. 139) | 5'-ATTTCATCCATGCTACAATTTATTTT-3' |
| AB003322-8(SEQ. ID No. 140) | 5'-AGAAGGCCGAGGAGGTCTCCGTGCTC-3' |
| AB003324-5(SEQ. ID No. 149) | 5'-TCGAGCGGGAGATCGAGATCGGGCGAGGCA-3' |
| AB003324-6(SEQ. ID No. 150) | 5'-AATTCATATTTCAGCATCCTTAAGAC-3' |
| AB003324-7(SEQ. ID No. 151) | 5'-ACTGTGCAGATGAGGTCATGCGCTCAT-3' |
| AB003324-8(SEQ. ID No. 152) | 5'-AGGCCTACGAGCTGTCCATCCTCTGCGA-3' |
| AB003324-9(SEQ. ID No. 153) | 5'-ACGCGTCCGGCCATCGCTGCCTAGCTAG-3' |
| AB077760-5(SEQ. ID No. 171) | 5'-GCTGCAGGGGCGGCCATCGGGAGGGGCAAGATCGA-3' |
| AB077760-6(SEQ. ID No. 172) | 5'-CGCACGGGGATCATCAAGAAGGCCAG-3' |
| AB077760-7(SEQ. ID No. 173) | 5'-TCGCCATCATCATCTTCTCCTCGAC-3' |
| AB077760-8(SEQ. ID No. 174) | 5'-ATGAAGAAGGCCAGGGTGCTCACCGTGCTCT-3' |
| AB095645-5(SEQ. ID No. 183) | 5'-AGGAGGCGGGATCGGGCGCGGGAAG-3' |
| AB095645-6(SEQ. ID No. 184) | 5'-GAAACGTGGGCCATCGCCATTGAGCGAAA-3' |
| AB095645-7(SEQ. ID No. 185) | 5'-TTCCTCTTCCTCCCATCGCGAACTCCT-3' |
| AB095645-8(SEQ. ID No. 186) | 5'-TGCCGTTTCTGGAGCTGCCCTACTGA-3' |
| AF139664-5(SEQ. ID No. 197) | 5'-AGAACAGGAGGAAGAAGGGGCGGGGCAA-3' |
| AF139664-6(SEQ. ID No. 198) | 5'-TACGCCACCGACTCAAGGTACGTACGTAC-3' |
| AF139664-7(SEQ. ID No. 199) | 5'-TCATTTTTCACAGTATCGACAAAATCCT-3' |
| AF139664-8(SEQ. ID No. 200) | 5'-TGGGCAGGAAAAGGCATGGCCCACCCCCA-3' |
| AF139664-9(SEQ. ID No. 201) | 5'-TGCTTTGATTAATACAGCTCGCAGCGAC-3' |
| AF139665-5(SEQ. ID No. 211) | 5'-CCGCCGACGACGATCGGGAGAGGGCCGGT-3' |
| AF139665-6(SEQ. ID No. 212) | 5'-TCTTCTGTAGTATCGAAGGGATCCTTG-3' |
| AF139665-7(SEQ. ID No. 213) | 5'-TCGCCGCGCGCGCGATGGGCGAGCT-3' |
| AF141964-5(SEQ. ID No. 222) | 5'-GGGTTTTTCGGGGCGGGAAGGCGCGGAGGGGGA-3' |
| AF141964-6(SEQ. ID No. 223) | 5'-TGAAGTTGTCCATGCTTACTAATACTCAAA-3' |
| AF141964-7(SEQ. ID No. 224) | 5'-ATTGGTTTTCCCATGCGTGTGATGGATATTC-3' |
| AF141964-8(SEQ. ID No. 225) | 5'-GACCAAAACCAGCCCATGCTGCATGGTACACTATTAGGCT-3' |
| AF141964-9(SEQ. ID No. 226) | 5'-CCTAATAAGAAACCGATGGGTATAAAATGGAGA-3' |
| AF141965-5(SEQ. ID No. 236) | 5'-GAGAGATCGGGATCGATCGTGCGGGGA-3' |
| AF141965-6(SEQ. ID No. 237) | 5'-TCCAAGCGCCGGAAAGGCCTCCTCAAGAA-3' |
| AF141965-7(SEQ. ID No. 238) | 5'-GAAAATGGAGGATGCAGAATATATATCCT-3' |
| AF141965-8(SEQ. ID No. 239) | 5'-AACAACTGTTCCAAGGAGCATGTCCAC-3' |
| AF141965-9(SEQ. ID No. 240) | 5'-CTTCTCGCGCGCCCGCGATTTCCGTT-3' |
| AF141965-10~~(SEQ. ID No. 241) | 5'-TCTCCCCCCGCGGCGGCCTCTACGA-3' |
| AF174093-5(SEQ. ID No. 250) | 5'-GGCGAGGTCGCGTTGGGCAAGGGAA-3' |
| AF174093-6(SEQ. ID No. 251) | 5'-GAAGATCGAGATCAAGAGGATCGAGGAC-3' |
| AF174093-7(SEQ. ID No. 252) | 5'-CGTGCTGTGCGAAGCGCAGGTCGGC-3' |
| AF174093-8(SEQ. ID No. 253) | 5'-AAGAAGGCGAACCAGCTCGCCGTGC-3' |
| AF204063-5(SEQ. ID No. 262) | 5'-AGGAGGAGGAAGAAGATCGGGAGGGGGAA-3' |
| AF204063-6(SEQ. ID No. 263) | 5'-TCTCCAGCTCATCTTGGTACGTATAGCA-3' |
| AF204063-7(SEQ. ID No. 264) | 5'-TTCACTTCCAGCATCTACAAAACCTTG-3' |
| AF204063-8(SEQ. ID No. 265) | 5'-ATCTTCTCCGGCCGCCGCCGCCTCTT-3' |
| AF204063-9(SEQ. ID No. 266) | 5'-GTCCAGCTAGCCAAGGATGGATATATTA-3' |
| AF345911-5(SEQ. ID No. 275) | 5'-AGCGGCGAGGATCGGGCGGGGGAAGGT-3' |
| AF345911-6(SEQ. ID No. 276) | 5'-GTTTTCCCTGCAGGATCGACAAAATCCT-3' |
| AF345911-7(SEQ. ID No. 277) | 5'-CGGCCGCTTCCATCGATTTCAGCTGCT-3' |
| AF424549-5(SEQ. ID No. 287) | 5'-AGGGGGCGGCGATGGGAGGGGCAAGAT-3' |
| AF424549-6(SEQ. ID No. 287) | 5'-CCGGACGGGGATCATCAAGAAGGCCAG-3' |
| AF424549-7(SEQ. ID No. 289) | 5'-AGGTCGCCATCATCAAGTTCTCCTCCA-3' |
| AF424549-8(SEQ. ID No. 290) | 5'-TTGCATCTATCCATCGTTAAAACAAGTC-3' |
| AJ293816-5(SEQ. ID No. 299) | 5'-TGTGTGATCTGATAAGGCTGGCGGCGGCGGT-3' |
| AJ293816-6(SEQ. ID No. 300) | 5'-TACATTGATGAAGCATCGAACAGATTATTG-3' |

TABLE 2-continued

Primers for constructing expression cassettes comprising regulatory sequences from the MADS gene family

| | |
|---|---|
| AY115556-5(SEQ. ID No. 309) | 5'-CTTATCTTGATCGATCGCGCGAGGCAAG-3' |
| AY115556-6(SEQ. ID No. 310) | 5'-TGAACAGAACCATCGAGGAGCTG-3' |
| AY115556-7(SEQ. ID No. 311) | 5'-AGCTCTGATATAGCATGGAGGTAATTG-3' |
| | |
| AY177695-5(SEQ. ID No. 320) | 5'-TCGATCGATTGAAGAAGGGGAGAGGGA-3' |
| AY177695-6(SEQ. ID No. 321) | 5'-GACAACACGAAGAACCGGCAGGTGAC-3' |
| AY177695-7(SEQ. ID No. 322) | 5'-CGCGGCGGGCTGATCAAGAAGGCCCGGGAG-3' |
| AY177695-8(SEQ. ID No. 323) | 5'-CTTTTTGTTAGCATCAAATCAATAATA-3' |
| AY177695-9(SEQ. ID No. 324) | 5'-TGAAGAGCAAACCATCGAGCTAACAAACACA-3' |
| AY177695-10~~(SEQ. ID No. 325) | 5'-TCAGGGATGACAACACGATGGCACCATCAGTCAT-3' |
| | |
| AY177696-5(SEQ. ID No. 334) | 5'-TAGCGGCGAAGAAGATCGGGAGGGGGAAGA-3' |
| AY177696-6(SEQ. ID No. 335) | 5'-GAGGTCGGCCTCAAGATCTTCTCCAG-3' |
| AY177696-7(SEQ. ID No. 336) | 5'-CAAATATGCAGCATCAAGTCAGTTAT-3' |
| AY177696-8(SEQ. ID No. 337) | 5'-CAGCATGGGCCATCGCCAGCTCTTCTCT-3' |
| | |
| AY177698-5(SEQ. ID No. 346) | 5'-ACCAACCTGATCAAAGGGCGTGGGA-3' |
| AY177698-6(SEQ. ID No. 347) | 5'-TCCAAGAGGAGGATCGGGCTGCTCAAGAAA-3' |
| AY177698-7(SEQ. ID No. 348) | 5'-AGGCACTGGCAAGAAGTACGAGTACT-3' |
| | |
| AY177699-5(SEQ. ID No. 360) | 5'-ATCGGCCAGAATCGGGAGGGGCGCA-3' |
| | |
| AY177700-5(SEQ. ID No. 370) | 5'-AAGAGTGAAACAACAAGGTCAGAGGA-3' |
| AY177700-6(SEQ. ID No. 371) | 5'-GAAAGGTGCAAATCCGACGAATAGAG-3' |
| AY177700-7(SEQ. ID No. 372) | 5'-ATTAGCTACTAAAGGGTGTGTTTCCA-3' |
| AY177700-8(SEQ. ID No. 373) | 5'-AAAATGCAAGAAATTTGCATAACTTG-3' |
| | |
| AY177702-5(SEQ. ID No. 382) | 5'-GAGAGCGAGGAGATCGGGAGGGGGAAGA-3' |
| AY177702-6(SEQ. ID No. 384) | 5'-TTACTTGCATGCTAGCTTGAAAACTGT-3' |
| AY177702-7(SEQ. ID No. 385) | 5'-ATCCTAAATTTTCATCGATGGCATCTAG-3' |
| AY177702-8(SEQ. ID No. 386) | 5'-GATCAGGACCATGCCAGTCTGATGGCCAA-3' |
| AY177702-9(SEQ. ID No. 387) | 5'-GCACAAGGAAAGCCTTGGAACATCTT-3' |
| | |
| AY224482-5(SEQ. ID No. 396) | 5'-GAGAGCGAGGAGATCGGGAGGGGGAAGA-3' |
| AY224482-6(SEQ. ID No. 397) | 5'-CTTGCATGCTAGCTTGAAAACTGTGA-3' |
| AY224482-7(SEQ. ID No. 398) | 5'-CTAAATTTTCATGCATGGCATCTAG-3' |
| AY224482-8(SEQ. ID No. 399) | 5'-TGATCAGGACCATCGCAGTCTGATGG-3' |
| AY224482-9(SEQ. ID No. 400) | 5'-CAAGGAAAGCCAAGGAACATCTTTAC-3' |
| | |
| AY250075-5(SEQ. ID No. 409) | 5'-AGAGAGAGAGATGAAGGGAGGGGGAA-3' |
| AY250075-6(SEQ. ID No. 410) | 5'-TATTGATAGTATCGAGCGAATCCTTG-3' |
| AY250075-7(SEQ. ID No. 411) | 5'-CAGTTGGTTGCCAAGGCGCGTTGCCGA-3' |
| AY250075-8(SEQ. ID No. 412) | 5'-GAGCCTCGGCCATGCCCAGCTCCTTCCT-3' |
| AY250075-9(SEQ. ID No. 413) | 5'-CTATTATTTTAAGAAAGCATGGATTATATAG-3' |
| AY250075-10~~(SEQ. ID No. 414) | 5'-TGAGACAGACCCATGCCTGGGCCTAC-3' |
| | |
| L37527-5~~(SEQ. ID No. 423) | 5'-GAGGAGTTGGATATCGGGCGCGGCAAGAT-3' |
| L37527-6~~(SEQ. ID No. 424) | 5'-ACCTCCATTCCTTGCATGGCGGCCT-3' |
| L37527-7~~(SEQ. ID No. 425) | 5'-TACTCCACTCCAACGATGGCGTCCAGT-3' |
| | |
| L37528-5~~(SEQ. ID No. 436) | 5'-AGCATACCCATCCATCTTGAACATGATGGT-3' |
| L37528-6~~(SEQ. ID No. 437) | 5'-CATCCATCTTGAACATCTTGGTAAATTCTGGCT-3' |
| | |
| U78891-5~~(SEQ. ID No. 447) | 5'-AGATCGATCGGGATCGGGAGGGGTCGGGT-3' |
| U78891-6~~(SEQ. ID No. 448) | 5'-GAACTTTGTAGCATCACTAAAACGCT-3' |
| U78891-7~~(SEQ. ID No. 449) | 5'-GTCCATGAAACAAACCGATGGTAATTGC-3' |
| | |
| AF095646-5(SEQ ID No. 512) | 5'-CAAAAGTTGAGGGATTGGATCGATCAGA-3' |
| AF095646-6(SEQ ID No. 513) | 5'-GATTGGATCGATCAGAGATCGGGAGGGGAAGGGT-3' |
| AF095646-7(SEQ ID No. 514) | 5'-GTTTTGTTTCCTTCGATGGGATGCGTATTC-3' |
| AF0956461-8~~(SEQ ID No. 515) | 5'-GAAGGCGTACGAGGTCTCCGTGCTCTG-3' | primers to mutagenize 3'-regulatory sequence

| | |
|---|---|
| AB003328-5(SEQ. ID No. 162) | 5'-CGTATTGTCGTCCATGCATGCGAAATGCTA-3' |
| | |
| AB095645-9(SEQ. ID No. 187) | 5'-GTAAAATTGCAGATCGATGGATGTCTCCA-3' |
| AB095645-10~~(SEQ. ID No. 188) | 5'-GAACCTCTCCATGCCGTGCACCCCG-3' |
| | |
| AF139664-10~~(SEQ. ID No. 202) | 5'-ACCTGACCCGGTCCCGTCGCCTGCTGCT-3' |
| | |
| AF141964-10~~(SEQ. ID No. 227) | 5'-AGAGAAAAGAGTTGCCTTGGCCTCTGGCTCTGC-3' |
| | |
| AF345911-8(SEQ. ID No. 278) | 5'-AGAACTATTCCAAGGTAATTGTACCATC-3' |

TABLE 2-continued

Primers for constructing expression cassettes comprising regulatory sequences from the MADS gene family

```
AY177698-8(SEQ. ID No. 349)     5'-AGGAGGCCAACCTGCATGGCTACGTTCTT-3'
AY177698-9(SEQ. ID No. 340)     5'-GCTCGTTTGATCCAAGGACAAGATCA-3'
AY 177698-10~(SEQ. ID No.351)   5'-TTCCTAAGGACACGATGGAGTCTGGA-3'

AY177699-6(SEQ. ID No. 361)     5'-AGTCGCCCCCGGCCTTTTAAGAGCCGCA-3'

AY177700-9(SEQ. ID No. 374)     5'-TAGGATTCATAACGATGGACATGTTC-3'

L37527-8~~(SEQ. ID No. 426)     5'-ACGGCAGCGGCCCGTCCGGCAGCTCCGGGA-3'
L37527-9~~(SEQ. ID No. 427)     5'-GAACCTCTCCATCGCGCCGCCCCGGGGGCT-3'

L37528-7~~(SEQ. ID No. 438)     5'-ATGTGAGGACCATCGATTGATGCATTG-3'

U78891-8~~(SEQ. ID No. 450)     5'-ACCTACATGCCCGCATGGCTACCATGAT-3'
U78891-9~~(SEQ. ID No. 451)     5'-TCGTCGTTTTCTCGATGGCCTTGCAT-3'
AF095646-9(SEQ ID No. 516)      5'-CCCTTCCTTACCCATGCTGGTAACAAATATG-3'
``` primers to clone 3'-regulatory sequence in pNOV6901

```
AB003322-9(SEQ. ID No. 141)     5'-TAATAAGAGCTCTGAAAGGAAAAAAAAAGCA-3'
AB003322-10~~(SEQ. ID No. 142)  5'-ATATATGCGGCCGCGGTCCGAATAAATCTGGCAACTGA-3'

AB003324-10~~(SEQ. ID No. 154)  5'-ATATATGCGGCCGCGGTCCGTGGAGATCGACCACAATTAAATTC-3'
AB003324-11~~(SEQ. ID No. 155)  5'-TAGGTAGAGCTCCTAGCTAGCTAGCTACCGTTTCA-3'

AB003328-6(SEQ. ID No. 163)     5'-TAATAAGAGCTCGTAACAGGCCAGGAATAAGCT-3'
AB003328-7(SEQ. ID No. 164)     5'-ATATATGCGGCCGCGGTCCGATTGCCGGGCTATAGCCTT-3'

AB077760-11~~(SEQ. ID No. 175)  5'-ATGCATGAGCTCTATATCATCGCCGC-3'
AB077760-12~~(SEQ. ID No. 176)  5'-ATATATGCGGCCGCGGTCCGTGGTACTGAAATC-3'

AB095645-13~~(SEQ. ID No. 189)  5'-TAATAAGAGCTCGCTGCTAGGTTGCCCCGCCACT-3'
AB095645-14~~(SEQ. ID No. 190)  5'-TAATAAGCGGCCGCGGTCCGCACGGCTACCTCTCGCCGGA-3'

AF139664-11~~(SEQ. ID No. 203)  5'-TAATAAGAGCTCGGAGGCTTCAGATCCATACCA-3'
AF139664-12~~(SEQ. ID No. 204)  5'-ATATATGCGGCCGCGGTCCGGATAAACATTGTGAAGCAAC-3'

AF139665-8(SEQ ID No. 214)      5'-TGATGAGCGGCCGCAGGCATCTGTTGATCTCA-3'
AF139665-9(SEQ ID No. 215)      5'-TATATAACTAGTGCGGTCCGATGAACTCCACCTCGGGAAC-3'

AF141964-11~~(SEQ. ID No. 228)  5'-TGATGAGCGGCCGCAGGAAGCACAGGTGT-3'
AF141964-12~~(SEQ. ID No. 229)  5'-ATATATCCCGGGCGGTCCGATGAGATACAATCTAGTAC-3'

AF141965-11~~(SEQ. ID No. 242)  5'-TGATGAGCGGCCGCAGAAGGCCAGCCACA-3'
AF141965-12~~(SEQ. ID No. 243)  5'-TATATACCCGGGCGGTCCGCCTTATCGAATATTCA-3'

AF174093-10~~(SEQ. ID No. 254)  5'-TGATGAGAGCTCCTTCCTGGAAGCAGTAG-3'
AF174093-11~~(SEQ. ID No. 255)  5'-ATATATGCGGCCGCGGTCCGCCCCTTCTCCTCCTCCGGGA-3'

AF204063-10~~(SEQ. ID No. 267)  5'-TATATACCCGGGCGGTCCGCTGCATATACTTGCAACA-3'
AF204063-11~~(SEQ. ID No. 268)  5'-TGATGAGCGGCCGCTGTGTGTTCAGTTCAG-3'

AF345911-9(SEQ. ID No. 279)     5'-TAATAAGCGGCCGCGATGATCATCGTCGTCGT-3'
AF345911-10~~(SEQ. ID No.280)   5'-TATATACCCGGGCGGTCCGTTGACTTAAATGGCAAG-3'

AF424549-9(SEQ. ID No. 291)     5'-TGATGAGCGGCCGCGATATCATCGCCGCCG-3'
AF424549-10~~(SEQ. ID No. 292)  5'-TATATACCCGGGCGGTCCGTTTTATTATCTTGGCGA-3'

A1293816-7(SEQ. ID No. 301)     5'-TGATGAGCGGCCGCTGGCTGGAAACTAAAACT-3'
AJ293816-8(SEQ. ID No. 302)     5'-TATATACCCGGGCGGTCCGTTTGAAACATTTCGGCCCT-3'

AY115556-8(SEQ. ID No. 312)     5'-TAATAAGCGGCCGCACTAATAATGGCCTGG-3'
AY115556-9(SEQ. ID No. 313)     5'-TATATACCCGGGCGGTCCGAACTTTGCACGAATG-3'

AY177695-11~~(SEQ. ID No. 325)  5'-TAATAAGAGCTCCACATGATCAAGTGTTAAAAAC-3'
AY177695-12~~(SEQ. ID No. 326)  5'-TATATAGCGGCCGCGGTCCGGCTCGGTCAAACCAGCGT-3'

AY177696-9(SEQ. ID No. 338)     5'-TGATGAGAGCTCCCAGAAAAACATTGTTTTG-3'
AY177696-10~~(SEQ. ID No. 339)  5'-TATATAGCGGCCGCGGTCCGTTTGGGATTGGAC-3'

AY177698-11~~(SEQ. ID No. 325)  5'-TGATGAGCGGCCGCTTGCCCTCTTTCCATC-3'
AY177698-12~~(SEQ. ID No. 353)  5'-TATATACCCGGGCGGTCCGTTAACCTAAAAGAAAT-3'

AY177699-7(SEQ. ID No. 362)     5'-TAGTAGGCGGCCGCAAACAGATGGACGCTTGA-3'
AY177699-8(SEQ. ID No. 363)     5'-TATATACCCGGGCGGTCCGAGGCTTGGTGCAAG-3'
```

TABLE 2-continued

Primers for constructing expression cassettes comprising regulatory sequences from the MADS gene family

```
AY177700-10~~(SEQ. ID No. 375) 5'-TAGTAGGCGGCCGCGTCAAAGGACCT-3'
AY177700-11~~(SEQ. ID No. 376) 5'-TATATACCCGGGCGGTCCGTAATTTTACTAGTACT-3'

AY177702-10~~(SEQ. ID No. 388) 5'-TAATAAGAGCTCGACTATGCCGTACAAGC-3'
AY177702-11~~(SEQ. ID No. 389) 5'-ATATATGCGGCCGCGGTCCGTGGTTGTCACAG-3'

AY224482-10~~(SEQ. ID No. 401) 5'-TAATAAGAGCTCGACTATGCCGTACAAGC-3'
AY224482-11~~(SEQ. ID No. 402) 5'-TATATAGCGGCCGCGGTCCGTGGTTGTCACAGA-3'

AY250075-11~~(SEQ. ID No. 415) 5'-TAGTAGAGCTCAAGATGTTCAGATGAAATG-3'
AY250075-12~~(SEQ. ID No. 416) 5'-TATATAGCGGCCGCGGTCCGAAAAAAATCACCGGCGT-3'

L37527-10~(SEQ. ID No. 428)    5'-TAGTAGAGCTCGCTGCTGAGCACTGCCA-3'
L37527-11~(SEQ. ID No. 429)    5'-TATATAGCGGCCGCGGTCCGTGCTGGTGCTCGAGGT-3'

L37528-8~~(SEQ. ID No. 439)    5'-TAGTAGAGCTCTTTTGGTGTAGACACC-3'
L37528-9~~(SEQ. ID No. 440)    5'-ATATAGCGGCCGCGGTCCGTGAAAGCTACATTTTAGC-3'

U78891-10~(SEQ. ID No. 452)    5'-TGATGAGCTCACAGTGCGTGCATGAACA-3'
U78891-11~(SEQ. ID No. 453)    5'-TATATAGCGGCCGCGGTCCGATGTTTTTTTTGTCTTTTGATGC-3'

AF095646-10~~(SEQ ID No. 517)  5'-ATATATCTCGAGCGGACCGTGTTGCATGCATGCGTACTGGTGA-3'
AF095646-11~~(SEQ ID No.518)   5'-ATATATCCATGGTGGGTTTATTCTGCAAACAAAAATAG-3'
``` primers to clone 5'-regulatory sequence in pNOV6901

```
AB003322-10~~(SEQ. ID No. 142) 5'-TATATACCATGGTGGTGATACTGTCCAACAGAAGG-3'
AB003322-11~~(SEQ. ID No. 143) 5'-ATATATGGATCCGGACCGTTGCCCAGCGAGGAGCATG-3'

AB003324-12~~(SEQ. ID No. 156) 5'-ATATATGGATCCGGACCGTCTAAATAGGGCCCAACATAC-3'
AB003324-13~~(SEQ. ID No. 157) 5'-TATATACCATGGTGGCTTAAGGATGCTGAAATATGA-3'

AB003328-8(SEQ. ID No. 165)    5'-TATATAGGATCCGGACCGAACAAAACCAATAATCTCCAATG-3'
AB003328-9(SEQ. ID No. 166)    5'-TATATACCATGGTGGATCGCCGATGAACCAACCAAC-3'

AB077760-9(SEQ. ID No. 177)    5'-ATATATGTCGACGGACCGATTCGTTGGGGGTGACATGAC-3'
AB077760-10~~(SEQ. ID No. 178) 5'-TACAGTACCATGGTGGCCCTTGATGCTGCAGCAGGAT-3'

AB095645-11~~(SEQ. ID No. 191) 5'-GAGAGACCTGCAGGCGGACCGCTCGTCGCCGTCGTTGGCTCGGCGT-3'
AB095645-12~~(SEQ. ID No. 192) 5'-ATATATCCATGGTGGTTGATAGCCTTATACATGTCCC-3'

AF139664-13~~(SEQ. ID No. 205) 5'-ATATATGGATCCGGACCGTGCATCCTTACAAAGAGACA-3'
AF139664-14~~(SEQ. ID No. 206) 5'-TATATACCATGGTGGTTGTCCATACTGTGAAAAATG-3'

AF139665-10~~(SEQ. ID No. 216) 5'-ATATATGTCGACGGACCGACCTGGGGTTTGGAAATG-3'
AF139665-11~~(SEQ. ID No. 217) 5'-TATATACCATGGTGGCCTTCCATACTACAGAAG-3'

AF141964-13~~(SEQ. ID No. 230) 5'-ATATATCCTGCAGGCGGACCGAAAACACTGATTAAAGGGT-3'
AF141964-14~~(SEQ. ID No. 231) 5'-ATATATCCATGGTGGGCTTCAATGCTGAAAAAGAAAAC-3'

AF141965-13~~(SEQ. ID No. 244) 5'-ATATATGGATCCGGACCGTGTTTCTCGATTAGGCTAC-3'
AF141965-14~~(SEQ. ID No. 245) 5'-ATATATCCATGGTGGTCTGTAGGCTGCAGAACAGACAC-3'

AF174093-12~~(SEQ. ID No. 256) 5'-TATATCCTGCAGGCGGACCGAAAATTCACAAGTATAATTC-3'
AF174093-13~~(SEQ. ID No. 257) 5'-TATATACCATGGTGGTCAAGCTTAACAAAGCAT-3'

AF204063-12~~(SEQ. ID No. 269) 5'-TATATAGGATCCGGACCGACAAATTTGTTGTACCAC-3'
AF204063-13~~(SEQ. ID No. 270) 5'-ATATATCCATGGTGGTGTACATGCTGGAAGTGA-3'

AF345911-11~~(SEQ. ID No. 281) 5'-TATATAGTCGACGGACCGAAAATCTCAAGGTTTC-3'
AF345911-12~~(SEQ. ID No. 282) 5'-TATATACCATGGTGGTTGTCGATCCTGCAGGGAA-3'

AF424549-11~~(SEQ. ID No. 293) 5'-TATATAGTCGACGGACCGTACAAAGTGCTGGAAGT-3'
AF424549-12~~(SEQ. ID No. 294) 5'-TATATAGCATGGTGGTGATGCTGCAGCAGGATGCA-3'

AJ293816-9(SEQ. ID No. 303)    5'-TATATAGTCGACGGACCGCAAACATTTTAAACTTTAAC-3'
AJ293816-10~~(SEQ. ID No. 304) 5'-TATATACCATGGTGGTGTTCGATGCTTCATCAATGT-3'

AY115556-10~~(SEQ. ID No. 314) 5'-TATATACCTGCAGGCGGACCGATATAAAAACCTACTTTATG-3'
AY115556-11~~(SEQ. ID No. 315) 5'-ATATATCCATGGTGGCGATGGTTCTGTTCAAAGAAATC-3'

AY177695-13~~(SEQ. ID No. 328) 5'-TATATAGGATCCGGACCGTCAGTCCATCATTTCGTC-3'
AY177695-14~~(SEQ. ID No. 329) 5'-TATATACCATGGTGGATTTGATGCTAACAAAAAGG-3'

AY177696-11~~(SEQ. ID No. 340) 5'-TATATAGGATCCGGACCGCAAGCAAAGAAACAAATTTCG-3'
AY177696-12~~(SEQ. ID No. 341) 5'-ATATACCATGGTGGCTTGATGCTGCATATTTG-3'
```

TABLE 2-continued

Primers for constructing expression cassettes comprising regulatory sequences from the MADS gene family

| | |
|---|---|
| AY177698-13~(SEQ. ID No. 354) | 5'-TATATAGGATCCGGACCGAAGATTTGAACTACTGCCT-3' |
| AY177698-14~(SEQ. ID No. 355) | 5'-TATATACCATGGTGGTTTGCAATCCTGCCA-3' |
| AY177699-9(SEQ. ID No. 364) | 5'-TATATAGGATCCGGACCGTCCGGTCGGCCCTCGTCCT-3' |
| AY177699-10~(SEQ. ID No. 365) | 5'-TATATACCATGGTGGCTCACGCTGCGCCA-3' |
| AY177700-12~(SEQ. ID No. 377) | 5'-TATATAGGATCCGGACCGATAAGTATTTCAGAAAG-3' |
| AY177700-13~(SEQ. ID No. 378) | 5'-TATATACCATGGTGGGCAAATTTCTTGCATTTTG-3' |
| AY177702-12~(SEQ. ID No. 390) | 5'-TATATAGTCGACGGACCGTCTTTTCGCAAACTAAAC-3' |
| AY177702-13~(SEQ. ID No. 391) | 5'-TATATACCATGGTGGTCAAGCTAGCATGCAAG-3' |
| AY224482-12~(SEQ. ID No. 403) | 5'-TATATAGTCGACGGACCGTCTTTTCGCAAACTAAACAAGG-3' |
| AY224482-13~(SEQ. ID No. 404) | 5'-TATATACCATGGTGGTTTTCAAGCTAGC-3' |
| AY250075-13~(SEQ. ID No. 417) | 5'-TATATACCTGCAGGCGGACCGAAATGGTTTCATTTTGG-3' |
| AY250075-14~(SEQ. ID No. 418) | 5'-TATATACCATGGTGGCGCTCGATACTATCA-3' |
| L37527-12~(SEQ. ID No. 430) | 5'-TATATACCTGCAGGCGGACCGCCAAGAGAGCCCCCT-3' |
| L37527-13~(SEQ. ID No. 431) | 5'-TATATACCATGGTGGTTGACAGCCTAAAACG-3' |
| L37528-10~(SEQ. ID No. 441) | 5'-TATATAGGATCCGGACCGACCACCTCAATCTCCACT-3' |
| L37528-11~(SEQ. ID No. 442) | 5'-TATATACCATGGTGGATCGGTCTGGACA-3' |
| U78891-12~(SEQ. ID No. 454) | 5'-TATATAGGATCCGGACCGTCTTCTTCTTGCCTTCATTTG-3' |
| U78891-13~(SEQ. ID No. 455) | 5'-TATATACCATGGTGGTTAGTGATGCTACAAAGTTC-3' |
| AF095646-12~(SEQ ID No. 519) | 5'-TATATAGAGCTCAGTCCAAGCTTGCTAATAAAAACGCT-3' |
| AF095646-13~(SEQ ID No. 520) | 5'-TATATACCCGGGCGGTCCGAAGGGTAGGGCTGCACGAA-3' |

EXAMPLE 2

1. Construction of the Assembly Vector pNOV6901 Containing the β-glucuronidase (GUS) Coding Sequence.

A. Preparation of GUS Coding Sequence.

The β-glucuronidase (GUS) coding sequence Narasimhulu, et al 1996, Plant Cell, 8: 873-886, which includes an engineered intron, was amplified from pNOV5003 in a Pfuturbo polymerase (Stratagene, Cat. No. 600250) reaction. The reaction mixture consisted of 1 µL pNOV5003 miniprep DNA 200 µM dNTPs, 20 µM GUS5 oligonucleotide primer 5'-atggtacgtcctgtagaaacc-3' (SEQ ID NO 498), 20 µM GUS3 oligonucleotide primer 5'-gatcgagctctcattgtttgcctccctg-3' (SEQ ID NO 499), 5 µL 10× cloned Pfu buffer and 2.5 Units of Pfuturbo DNA polymerase (Stratagene, Cat. No. 600250) in a final volume of 50 µL. The thermocycling program was at 95° C. for 30 seconds then 10 cycles of (95° C. for 5 seconds, 55° C. for 10 seconds, 72° C. for 2.5 minutes) then 20 cycles of (95° C. for 5 seconds, 57° C. for 15 seconds, 72° C. for 2.5 minutes) then 72° C. for 2.5 minutes. The 2.2 kb GUS PCR product was isolated and concentrated using the QIAEX II kit (Qiagen, Cat. No. 20021). The GUS PCR product was recovered in 15 µL ddH$_2$O and subsequently digested in a 20 µL reaction containing 1 µg BSA, 2 µL 10× restriction endonuclease buffer and 1 µL SacI. The reaction was incubated at 37° C. for 2 hours. The GUS PCR product (SacI) was resolved on 1.5% TBE agarose and the 2.2 kb GUS PCR product (SacI) band was excised. The GUS PCR product (SacI) DNA was recovered from the agarose in 15 µL ddH$_2$O with the QIAEX II kit (Qiagen, Cat. No. 20021).

B. Preparation of the pSP73 Vector.

An *E. coli* vector pSP73 (Promega, Cat. No. P2221) miniprep DNA was prepared. 1 µL of the miniprep DNA was digested in a 20 µL reaction mixture containing 1 µg BSA, 2 µL 10× restriction endonuclease, 1 µL SmaI and 1 µL SacI. The reaction was incubated at 25° C. for 1.5 hours then 37° C. for 1.5 hours. The pSP73 (SmaI/SacI) DNA was resolved on 1.5% TBE agarose and the 2.4 kb pSP73 (SmaI/SacI) band was excised. The pSP73 (SmaI/SacI) DNA was recovered from the agarose in 15 µL ddH$_2$O with the QIAEX II kit (Qiagen, Cat No. 20021).

C. Construction of pSP73-GUS

5 µL of pSP73 (SmaI/SacI) was ligated to 5 µL GUS PCR product (SacI) by mixing with an equal volume of Takara DNA Ligation Mix, Version II (Cat. No. TAK 6022) and incubating at 16° C. for 30 minutes. 7.5 µL of the ligation mixture was transformed into 50 µL XL-1 supercompetent cells (Stratagene, Cat. No. 200236). pSP73-GUS recombinants were verified by digesting 2 µL pSP73-GUS miniprep DNA in a 20 µL reaction containing 2 µg BSA, 2 µL 10× restriction endonuclease buffer, 1 µL XbaI and 1 µL SacI and the pSP73-GUS (XbaI/SacI) products were resolved on 1.5% TBE agarose. The positive pSP73-GUS recombinants were sequenced.

D. Addition of Restriction Endonuclease Sites to pSP73-GUS

The pSP73-GUS construct lacks flexibility to clone 3'-regulatory sequence just after the GUS coding sequence. Additional restriction sites were added to the polylinker to increase flexibility at the 3'-terminus of the GUS coding sequence by ligating a synthetic adapter to the construct. The adapter (Synthetic Adaptor I) was made by combining 40 µL of 50 µM oligonucleotide PL-F 5'-Pccgcgggcggccgcactagtcccgggcccat-3' (SEQ ID NO. 456), 40 µL of 50 µM oligonucleotide PL-R 5'-Pcgatgggcccgggactagtgcggccgcccgcggagct-3' (SEQ ID NO. 457)—where P is a 5'-phosphate group—in a 100 µL mixture that is 25 mM in Tris-HCl (pH 8.0) and 10 mM in MgCl$_2$. The mixture was boiled for 5 minutes, removed from heat and naturally cooled to room temperature (about 60 minutes), yielding a 20 µM Synthetic Adaptor I solution.

The pSP73-GUS construct was prepared by digesting 14 µL of miniprep pSP73-GUS DNA with 1 µL SacI and 1 µL ClaI in a 20 µL reaction mixture containing 2 µg BSA and 2

μL 10× restriction endonuclease buffer. The reaction mixture was incubated at 37° C. for 6 hours, then at 70° C. for 20 minutes. Then 1 μL of the appropriate 10× restriction endonuclease buffer, 1 μL 1 Unit/μL CIP and 8 μL ddH$_2$O were added to the reaction and it was further incubated at 37° C. for 30 minutes. The pSP73-GUS (SacI/ClaI/CIP) DNA was resolved on 1% TAE agarose, excised, recovered and ethanol precipitated with glycogen carrier. The pSP73-GUS (SacI/ClaI/CIP) DNA was recovered by micro centrifugation, washed with 70% ethanol, dried under vacuum and resuspended in 5 μL ddH$_2$O.

4.5 μL of Synthetic Adaptor I solution was ligated to 2.5 μL pSP73-GUS (SacI/ClaI/CIP) in a 10 μL ligation mixture containing 1 μL 10× T4 DNA ligase buffer and 1 μL T4 DNA ligase and incubated more than 8 hours at 16° C. 4 μL of the ligation mixture was transformed into 50 μL XL-1 supercompetent cells (Stratagene, Cat. No. 200236). The pSP73-GUS-mod recombinants were verified by digesting 5 μL pSP73-GUS-mod miniprep DNA in a 20 μL reaction containing 2 μg BSA, 2 μL 10× restriction endonuclease buffer and 1 μL NotI. The digests were resolved on 1.0% TAE agarose, and the sequence of positive pSP73-GUS-mod recombinants was verified. The finished clone was designated pNOV6901.

2. Construction of pNOV6900

It was necessary to construct an *Agrobacterium* binary vector to facilitate mobilization of expression cassettes constructed in pNOV6901 into plants. The pNOV2115 vector was modified by inserting an adaptor that introduces the PacI, SgfI and RsrII restriction endonuclease recognition sites. pNOV2115 miniprep DNA (14 μL) was digested with 1 μL KpnI and 1 μL HindIII in a 20 μL reaction mixture containing 2 μg BSA and 2 μL 10× restriction endonuclease buffer. Digests were incubated at 37° C. for more than 6 hours, then at 70° C. for 20 minutes. Then 1 μL of the appropriate 10× restriction endonuclease buffer, 1 μL 1 Unit/μL CIP and 8 μL ddH$_2$O were added to the reaction and it was further incubated at 37° C. for 30 minutes. pNOV2115 (KpnI/HindIII/CIP) was resolved on 1% TAE agarose, the 9.2 kb pNOV2115 (KpnI/HindIII/CIP) DNA band was excised, recovered and ethanol precipitated with glycogen carrier. The pNOV2115 (KpnI/HindIII/CIP) DNA was recovered by micro centrifugation, washed with 70% ethanol, dried under vacuum and resuspended in 5 μL ddH$_2$O.

Additional restriction sites were added to pNOV2115 (KpnI/HindIII/CIP) by ligating the vector to Synthetic Adapter II. The Synthetic Adapter II was made by combining 37 μL of 150 μM oligonucleotide PL1 5'-Pgtaccggaccgcgatcgcttaatta-3' (SEQ ID NO 458), 37 μL of 150 μM PL2 oligonucleotide 5'-Pagcttaattaagcgatcgcggtccg-3' (SEQ ID NO 459)—where P is a 5'-phosphate group—in a 100 μL mixture that is 25 mM in Tris-HCl (pH 8.0) and 10 mM in MgCl$_2$. The mixture was boiled for 5 minutes, removed from heat and naturally cooled to room temperature (about 60 minutes), yielding a 55 μM Synthetic Adapter II solution.

2.5 μL pNOV2115 (KpnI/HindIII/CIP) was ligated to 2.5 μL 55 μM Synthetic Adapter II solution by mixing with an equal volume of Takara DNA Ligation Mix, Version II (Cat. No. TAK 6022), and was incubated at 16° C. for 30 minutes. 5.0 μL of ligation mixture was transformed into 50 μL DH5α competent cells (Invitrogen, Cat. No. 18258-012). pNOV2115-mod recombinants were verified by digesting 2 μL pNOV2115-mod miniprep DNA with KpnI, HindIII, PacI or RsrII in 10 μL reactions containing 1 μg BSA and 1 μL 10× restriction endonuclease buffer. The sequence of positive pNOV2115-mod recombinants was verified. The finished clone was designated pNOV6900.

EXAMPLE 3

Construction of the OsMADS5 Expression Cassette

A. Cloning the OsMADS5 5'-Regulatory Sequence

High-fidelity PCR was used to amplify the OsMADS5 5'-regulatory sequence from rice genomic DNA (gDNA). The 50 μL reaction mixture consisted of 100 ng rice gDNA, 200 μM dNTPs, 1 μL 20 μM oligonucleotide primer OsMADS5-P3 5'-tgagcaggtagccggcgaccaatcgcgag-3' (SEQ ID NO 460), 1 μL 20 μM oligonucleotide primer OsMADS#5-P2 5'-catactgttacaaaaaagaaaatcagtggaccac-3' (SEQ ID NO 461), 1 μL 10× Expand High Fidelity buffer and 1 μL Expand High Fidelity polymerase. The thermocycling program was at 95° C. for 2 minutes followed by 40 cycles of (94° C. for 15 seconds, 68° C. for 7.5 minutes) followed by 68° C. for 10 minutes. The 5.4 kb DNA product, encoding the OsMADS5 5'-regulatory sequence, was cloned with the TOPO XL PCR cloning kit. The pCR-XL-TOPO-OsMADS5-5'-gDNA recombinants, containing the OsMADS5 5'-regulatory sequence, were identified by digesting 5 μL pCR-XL-TOPO-OsMADS5-5'-gDNA miniprep DNA with EcoRI in a 20 μL reaction mixture containing 2 μg BSA and 2 μL 10× restriction endonuclease buffer. The reaction mixture was incubated at 37° C. for 2 hours then the pCR-XL-TOPO-OsMADS5-5'-gDNA (EcoRI) products were resolved on 1% TAE agarose. Positive pCR-XL-TOPO-OsMADS5-5'-gDNA clones were sequenced.

B. Cloning the OsMADS5 3'-Regulatory Sequence

High-fidelity PCR was used to amplify the OsMADS5 3'-regulatory sequence from rice genomic DNA (gDNA). The 50 μL reaction mixture consisted of 100 ng rice gDNA, 200 μM dNTPs, 1 μL 20 μM oligonucleotide primer OsMADS#5-T1 5'-atgaattgcttatcacattaatggacatc-3' (SEQ ID NO. 462), 1 μL 20 μM oligonucleotide primer OsMADS#5-T2 5'-caaaactacatcaagagccttggaattggtcc-3' (SEQ ID NO. 463), 1 μL 10× Expand High Fidelity buffer and 1 μL Expand High Fidelity polymerase. The thermocycling program was 95° C. for 2 minutes followed by 40 cycles of (94° C. for 15 seconds, 60° C. for 30 seconds, 68° C. for 6 minutes) followed by 68° C. for 15 minutes. The 1.2 kb OsMADS5-3'-gDNA DNA product, encoding the OsMADS5 3'-regulatory sequence, was cloned with the Zero Blunt TOPO PCR cloning kit (Invitrogen, Cat. No. K2875-20). pCR-Blunt II-TOPO-OsMADS5-3'-gDNA recombinants, with the OsMADS5 3'-regulatory sequence, were identified by digesting 5 μL pCR-Blunt II-TOPO-OsMADS5-3'-gDNA miniprep DNA with EcoRI in a 20 μL reaction mixture containing 2 μg BSA and 2 μL 10× restriction endonuclease buffer. The reaction mixture was incubated at 37° C. for 2 hours and then the pCR-Blunt II-TOPO-OsMADS5-3'-gDNA (EcoRI) products were resolved on 1% TAE agarose. Positive pCR-Blunt II-TOPO-OsMADS5-3'-gDNA clones were sequenced.

C. Construction of the OsMADS5 5'-Regulatory Sequence

The OsMADS5 5'-regulatory sequence for the expression cassette was made in several steps. The 3'-half (OsMADS-5Pb, about 3.03 kb) was produced by high-fidelity PCR from the pCR-XL-TOPO-OsMADS5-5'-gDNA clone described above. The reaction mixture consisted of 1 μL pCR-XL-TOPO-OsMADS5-5'-gDNA miniprep DNA, 200 μM dNTPs, 20 μM oligonucleotide primer OsMADS5-C3 5'-cagtgtcgacggggcgagggaaagtagagc-3' (SEQ ID NO 464), 20 μM oligonucleotide primer OsMADS5-C4 5'-cgatccatggtggatactgttacaaaaaagaaaatcagtg-3' (SEQ ID NO 465), 5 μL 10× cloned Pfu buffer and 2.5 Units of Pfuturbo DNA polymerase (Stratagene, Cat. No. 600252) in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The OsMADS-5Pb DNA product was recovered using the QIAquick PCR purification kit (Qiagen, Cat. No. 28106). The recovered OsMADS-5Pb DNA was ethanol precipitated with glycogen carrier. The OsMADS-5Pb DNA was recovered by micro centrifugation, washed with 70% ethanol, dried under vacuum and resuspended in 14 µL ddH$_2$O. The OsMADS-5Pb was digested in a 20 µL reaction mixture containing 2 µg BSA, 2 µL 10× restriction endonuclease buffer, 1 µL SalI and 1 µL NcoI. The reaction mixture was incubated at 37° C. for more than 6 hours. The OsMADS-5Pb (NcoI/SalI) DNA was resolved on 1.0% TAE agarose and the 3.03 kb OsMADS-5Pb (NcoI/SalI) DNA band was excised, recovered and ethanol precipitated with glycogen carrier. The OsMADS-5Pb (NcoI/SalI) DNA was recovered by micro centrifugation, washed with 70% ethanol, dried under vacuum and resuspended in 5 µL ddH$_2$O.

2 µg of the pNOV6901 miniprep DNA was digested in a 20 µL reaction mixture containing 2 µg BSA, 2 µL 10× restriction endonuclease buffer, 1 µL SalI and 1 µL NcoI. The reaction mixture was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901 (NcoI/SalI/CIP) DNA was resolved on 1.0% TAE agarose and the 4.7 kb pNOV6901 (NcoI/SalI/CIP) band was excised, recovered and ethanol precipitated with glycogen carrier. The pNOV6901 (NcoI/SalI/CIP) DNA was recovered by micro centrifugation, washed with 70% ethanol, dried under vacuum and resuspended in 5 µL ddH$_2$O.

4.0 µL of the OsMADS-5Pb (NcoI/SalI) was ligated to 4.0 µL pNOV6901 (NcoI/SalI/CIP) in a 10 µL reaction mixture containing 1 µL 10× T4 DNA ligase buffer and 1 µL T4 DNA ligase (400 Units/µL) and incubated more than 8 hours at 16° C. 5.0 µL of the ligation mixture was transformed into 50 µL Top10 competent cells. pNOV6901-OsMADS-5Pb recombinants were verified by digesting 2 µL pNOV6901-OsMADS-5Pb miniprep DNA with 0.5 µL SalI, 0.5 µL NcoI in 10 µL reactions containing 1 µg BSA and 1 µL 10× restriction endonuclease buffer. The digests were incubated at 37° C. for 2 hours and the pNOV6901-OsMADS-5Pb (NcoI/SalI) DNA was resolved on 1% TAE agarose. Positive pNOV6901-OsMADS-5Pb recombinants were sequenced.

The 5'-half (OsMADS-5 Pa, about 2.4 kb) was produced by high-fidelity PCR from the pCR-XL-TOPO-OsMADS5-5'-gDNA clone described above. The reaction mixture consisted of 1 µL pCR-XL-TOPO-OsMADS5-5'-gDNA miniprep DNA, 200 µM dNTPs, 20 µM oligonucleotide primer OsMADS5-C1 5'-gactctcgaggcgcgcctgagcagg-tagccggcgacc-3' (SEQ ID NO 466), 20 µM oligonucleotide primer OsMADS5-C2b 5'-gtgtgtctcgagctctctctagctctctctcgg-3' (SEQ ID NO 467), 5 µL 10× cloned Pfu buffer and 2.5 Units of Pfuturbo DNA polymerase (Stratagene, Cat. No. 600252) in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The 2.4 kb OsMADS-5 Pa DNA product was cloned with the Zero Blunt TOPO PCR cloning kit (Invitrogen, Cat. No. K2875-20). pCR-Blunt II-TOPO-OsMADS-5 Pa recombinants were identified by digesting 5 µL pCR-Blunt II-TOPO-OsMADS-5 Pa miniprep DNA with EcoRI in a 20 µL reaction mixture containing 2 µg BSA and 2 µL 10× restriction endonuclease buffer. The digests were incubated at 37° C. for 2 hours then resolved on 1% TAE agarose. Positive pCR-Blunt II-TOPO-OsMADS-5 Pa recombinants were sequenced.

2 µg of the pNOV6901-OsMADS-5Pb miniprep DNA was digested in a 20 µL reaction mixture containing 2 µg BSA, 2 µL 10× restriction endonuclease buffer and 2 µL XhoI. The digest was incubated at 37° C. for more than 6 hours, then at 70° C. for 20 minutes. Then 1 µL of the appropriate 10× restriction endonuclease buffer, 1 µL 1 Unit/mL CIP and 8 µL ddH$_2$O were added to the reaction and it was further incubated at 37° C. for 30 minutes. 2 µg of the pCR-Blunt II-TOPO-OsMADS-5 Pa miniprep DNA was digested in a 20 µL reaction mixture containing 2 µg BSA, 2 µL 10× restriction endonuclease buffer and 2 µL SalI. The digest was incubated at 37° C. for more than 6 hours.

The digested plasmid DNAs, pNOV6901-OsMADS-5Pb (XhoI/CIP) and pCR-Blunt II-TOPO-OsMADS-5 Pa (SalI), were resolved on 1.0% TAE agarose and the 7.7 kb pNOV6901-OsMADS-5Pb (XhoI/CIP) and the 2.4 kb OsMADS-5 Pa (SalI) bands were excised, extracted, recovered and ethanol precipitated with glycogen. The pNOV6901-OsMADS-5Pb (XhoI/CIP) and OsMADS-5 Pa (SalI) DNA fragments were recovered by micro centrifugation, washed with 70% ethanol, dried under vacuum and resuspended each in 5 µL ddH$_2$O.

4.0 µL of the pNOV6901-OsMADS-5Pb (XhoI/CIP) was ligated to 4.0 µL OsMADS-5 Pa (SalI) in a 10 µL reaction mixture containing 1 µL 10× T4 DNA ligase buffer and 1 µL T4 DNA ligase (400 U/µL). The reaction mixture was incubated more than 8 hours at 16° C. 5.0 µL of the ligation mixture was transformed into 50 µL Top10 competent cells. The pNOV6901-OsMADS5P recombinants were verified by digesting 2 µL pNOV6901-OsMADS5P miniprep DNA with 0.5 µL XhoI, 0.5 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS5P recombinants were sequenced.

D. Construction of the OsMADS5 3'-Regulatory Sequence

The OsMADS-5 3'-regulatory sequence for the expression cassette was produced by high-fidelity PCR from the pCR-Blunt II-TOPO-OsMADS5-3'-gDNA clone, above. The reaction mixture consisted of 1 µL pCR-Blunt II-TOPO-OsMADS5-3'-gDNA miniprep DNA, 200 µM dNTPs, 20 µM oligonucleotide primer OsMADS5T-F 5'-cccgggc-catgggggtctagaatgaattgcttatcacattaatgg-3' (SEQ ID NO 468), 20 µM oligonucleotide primer OsMADS5T-R 5'-cccgggcgcgccggatgagaacagctacatcc-3' (SEQ ID NO 469), 5 µL 10× cloned Pfu buffer and 2.5 Units of Pfuturbo DNA polymerase (Stratagene, Cat. No. 600252) in a final volume of 50 µL. The thermocycling program was 95° C. for 30 seconds then 40 cycles of (95° C. for 10 seconds, 50° C. for 60 seconds, 72° C. for 6 minutes) then 72° C. for 10 minutes. The OsMADS5T DNA product was recovered using the QIAquick PCR purification kit (Qiagen, Cat. No. 28106) and ethanol precipitated with glycogen carrier. The OsMADS5T DNA was recovered by micro centrifugation, washed with 70% ethanol, dried under vacuum and resuspended in 14 µL ddH$_2$O. The OsMADS5T DNA was digested in a 20 µL reaction mixture containing 2 µg BSA, 2 µL 10× restriction endonuclease buffer and 2 µL XmaI. The digest was incubated at 37° C. for more than 6 hours. The OsMADS5T (XmaI) DNA was resolved on 1.0% TAE agarose and the 1.1 kb OsMADS5T (XmaI) band was excised, recovered and ethanol precipitated with glycogen carrier. OsMADS5T (XmaI) DNA was recovered by micro centrifugation, washed with 70% ethanol, dried under vacuum and resuspended in 5 µL ddH$_2$O.

2 µg pNOV6901-OsMADS5P miniprep DNA was digested in a 20 µL reaction mixture containing 2 µg BSA, 2 µL 10× restriction endonuclease buffer and 2 µL XmaI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901-OsMADS5P (XmaI/CIP) DNA was resolved on 1.0% TAE agarose and the 10.1 kb pNOV6901-OsMADS-5P (XmaI/CIP) band was excised, recovered and ethanol precipitated with glycogen carrier. pNOV6901-OsMADS-5P (XmaI/CIP) DNA was recovered by micro centrifugation, washed with 70% ethanol, dried under vacuum and resuspended each in 5 µL ddH$_2$O.

4.0 µL pNOV6901-OsMADS5P (XmaI/CIP) was ligated to 4.0 µL OsMADS5T (XmaI) in a 10 µL ligation mixture containing 1 µL 10× T4 DNA ligase buffer and 1 µL T4 DNA ligase (400 Units/µL) and incubated more than 8 hours at 16° C. 5.0 µL of ligation mixture was transformed into 50 µL Top10 competent cells. Positive pNOV6901-OsMADS5P/OsMADS5T recombinants were verified by digesting 2 µL miniprep DNA with 1.0 µL AscI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS5P/OsMADS5T recombinants were sequenced. The construct was designated pNOV6901-OsMADS5P/OsMADS5T. The plasmid's QC number is 11084. 11084 contains the complete OSMADS5 expression cassette depicted by SEQ ID NO. 536.

E. Mobilization of the OsMADS5 GUS Expression Cassette into pNOV6900

2 µg pNOV6900 was digested in a 20 µL reaction mixture containing 2 µg BSA, 2 µL 10× restriction endonuclease buffer and 2 µL AscI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pNOV6901-OsMADS5P/OsMADS5T miniprep DNA was digested in a 20 µL reaction mixture containing 2 µg BSA, 2 µL 10× restriction endonuclease buffer and 2 µL AscI. The digest was incubated at 37° C. for more than 6 hours.

The digested plasmid DNAs, pNOV6900 (AscI/CIP) and pNOV6901-OsMADS5P/OsMADS5T (AscI), were resolved on 1.0% TAE agarose and the 9.2 kb pNOV6900 (AscI/CIP) and the 8.7 kb pNOV6901-OsMADS5P/OsMADS5T (AscI) DNA bands were excised, recovered and ethanol precipitated with glycogen carrier. The pNOV6900 (AscI/CIP) and pNOV6901-OsMADS5P/OsMADS5T (AscI) DNA fragments were recovered by micro centrifugation, washed with 70% ethanol, dried under vacuum and resuspended in 5 µL ddH$_2$O each.

4.0 µL pNOV6900 (AscI/CIP) was ligated to 4.0 µL pNOV6901-OsMADS5P/OsMADS5T (AscI) in a 10 µL ligation mixture containing 1 µL 10× T4 DNA ligase buffer and 1 µL T4 DNA ligase, which was incubated more than 8 hours at 16° C. 5.0 µL of ligation mixture was transformed into 50 µL Top10 competent cells. pNOV6900-pNOV6901-OsMADS5P/OsMADS5T recombinants were verified by digesting 7.5 µL pNOV6900-pNOV6901-OsMADS5P/OsMADS5T miniprep DNA with 1.0 µL NcoI in 10 µL reactions containing 1 µg BSA and 1 µL 10× restriction endonuclease buffer. The digests were incubated at 37° C. for 2 hours then resolved on 1% TAE agarose. Positive pNOV6900-pNOV6901-OsMADS5P/OsMADS5T recombinants were sequenced. The finished clone was designated pNOV6911. The plasmid's QC number is 11085.

The engineered alterations in the OsMADS5P sequence include introduction of an XhoI site followed by an AscI site at the 5'-end of the OsMADS5P sequence, elimination the natural translation start codon of the OsMADS5P sequence, elimination of undesired ORFs in the new leader sequence (5'-UTR) of the OsMADS5P sequence, insertion a Kozak sequence upstream of the new translation start codon of the OsMADS5P sequence and insertion of a new translation start codon downstream of the intron1/exon2 junction as an NcoI site in the OsMADS5P sequence. The engineered alterations in the OsMADS5T sequence include introduction of an XmaI site at the 5'-terminus of the OsMADS5T sequence and introduction of an AscI site at the 3'-terminus of the OsMADS5T sequence. In this configuration the GUS coding sequence can be replaced with any gene of interest flanked by NcoI restriction sites. The complete cassette can then be excised as an AscI fragment and cloned into pNOV6900.

The cassette was transformed into A188 X HyII maize and Kaybonnet rice using standard *agrobacterium* mediated methodology.

GUS Expression in T0 Maize

Fifteen T0 transgenic maize lines were generated. Tassel spikelets and leaf punches were harvested just before pollen shed and histochemically screened for GUS activity. The ear from a plant containing multiple transgene copies was sacrificed to examine GUS expression in developing florets. Gus activity localized primarily to transmitting tissue at the base of each floret, and to a lesser extent, the vascular bundles in developing ears. GUS activity was also apparent in developing silks. These data indicate the cassette drives GUS expression primarily in female reproductive tissue.

GUS Expression in T0 Rice

Of forty T0 rice (cv. Kaybonnet) lines containing pNOV6911 (or 11085), eighteen independent transformants were histochemically stained for GUS expression. Only four events had detectable GUS activity in leaf tissue. In most events, activity in spikelets was localized to glume tips, and anthers to a much lesser extent.

GUS Expression in T1 Maize

Figure 3:
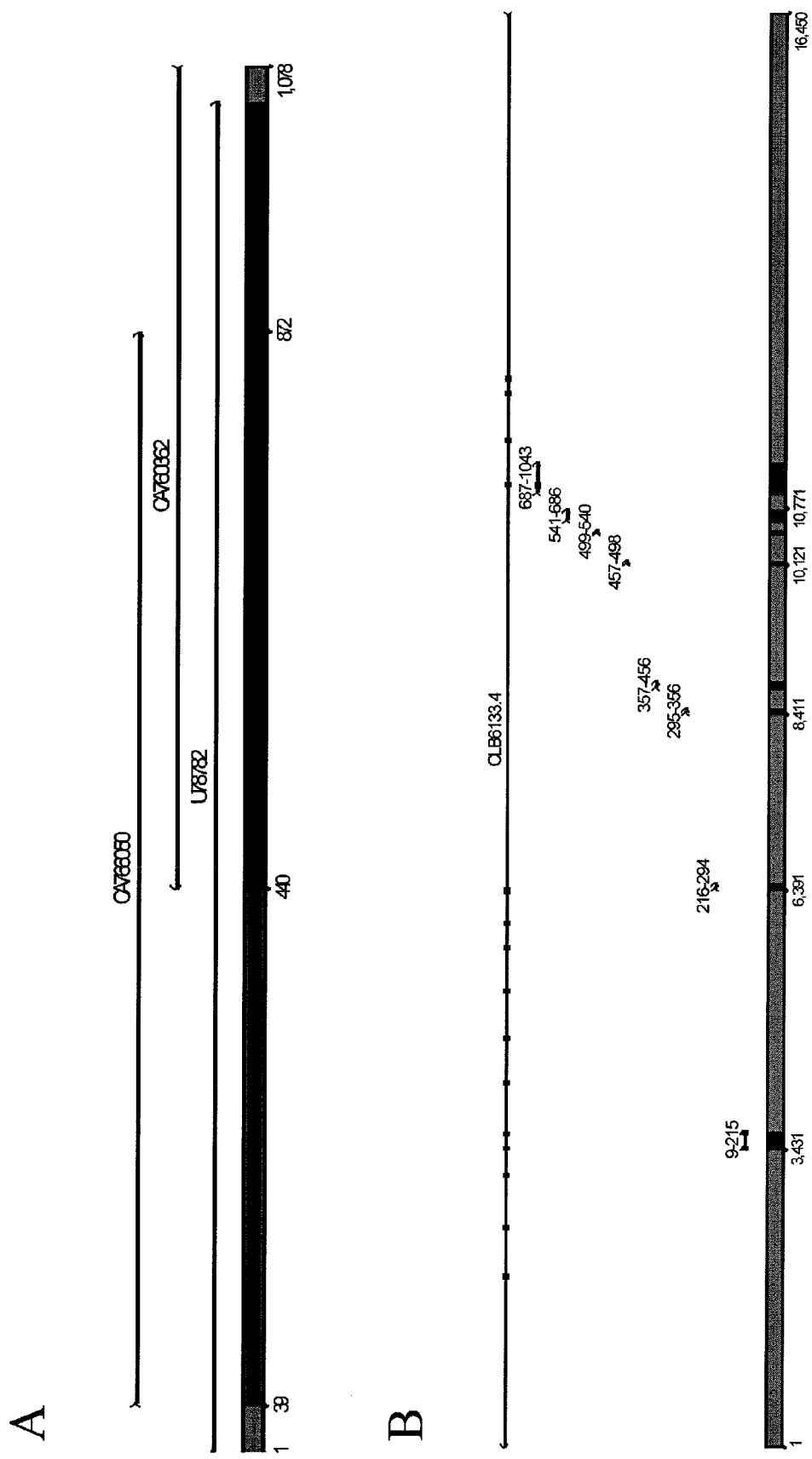
FIGS. 3A and 3B are schematic representations of the OsMADS 6 cDNA and of the annotation of the OsMADS6 gDNA with OsMADS6 cDNA sequence.
Figure 4:
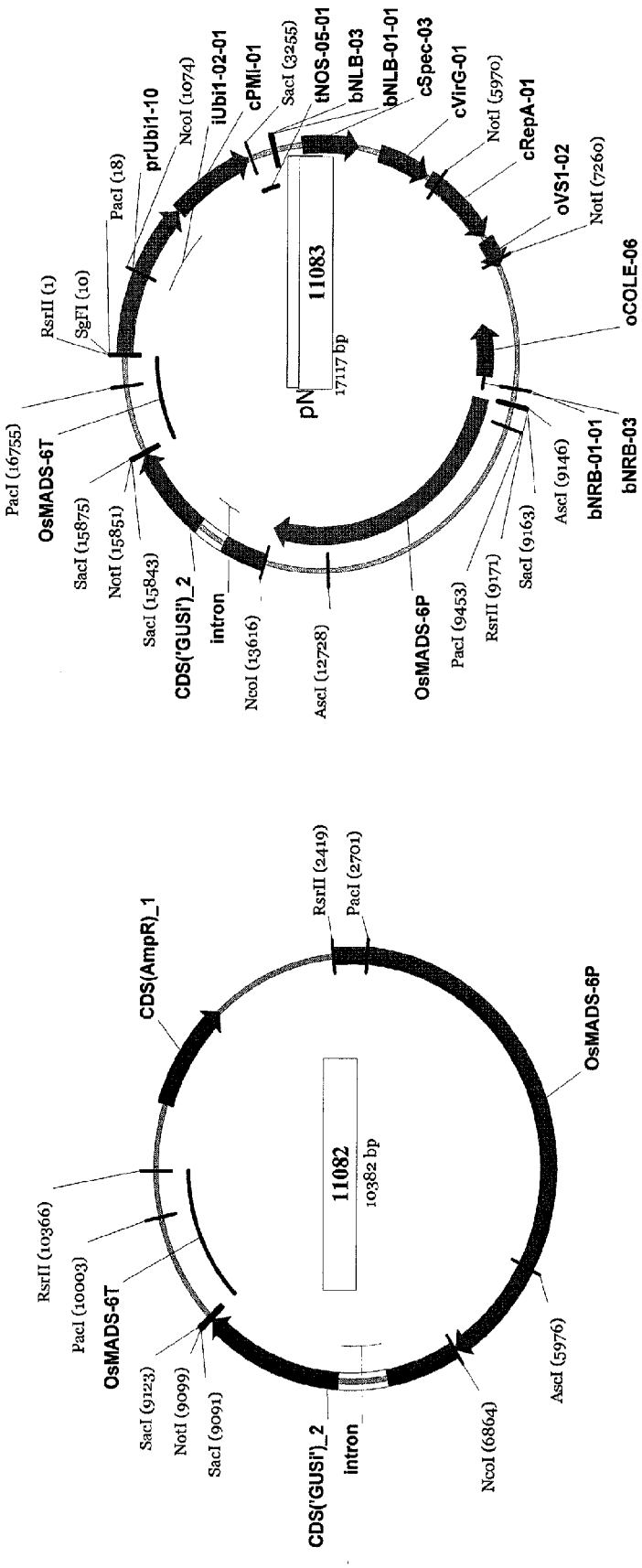
FIG. 4A is a schematic representation of the OsMADS6 assembly vector.
FIG. 4B is a schematic representation of the OsMADS6 binary vector.
Figure 5:
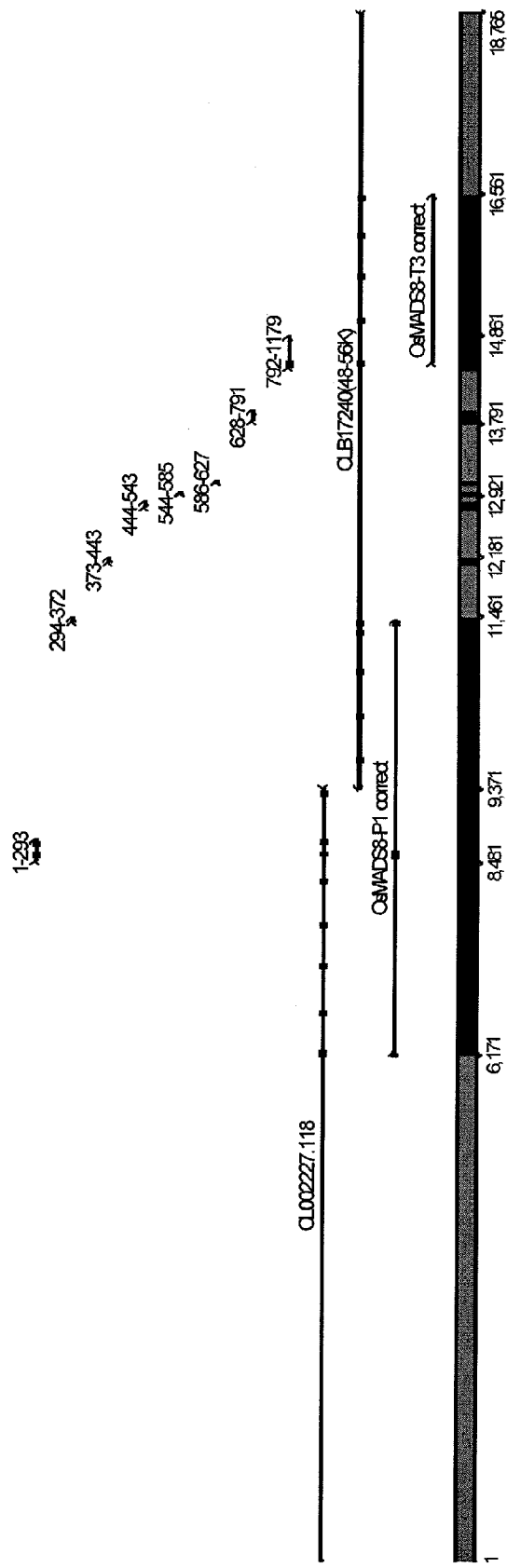
FIG. 5 is a schematic representation of the annotation of the OsMADS8 gDNA with OsMADS8 cDNA sequence
Figure 6:
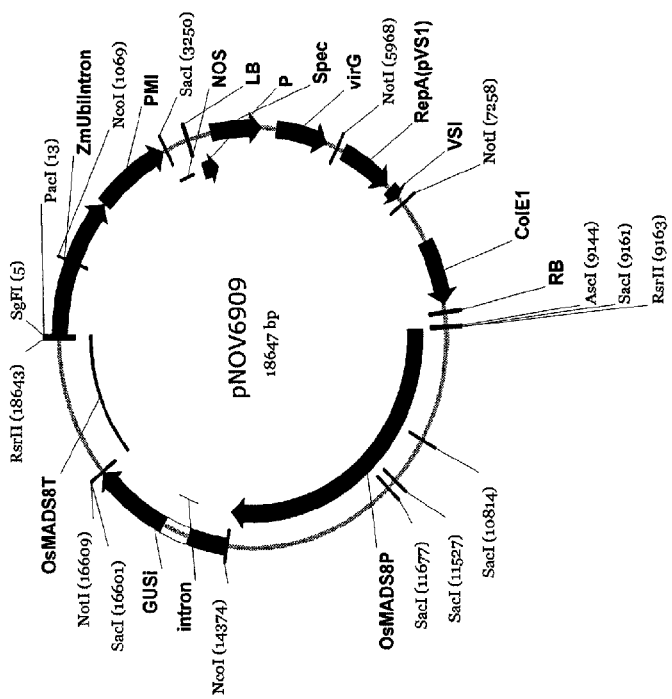
FIG. 6A is a schematic representation of the OsMADS8 assembly vector.
FIG. 6B is a schematic representation of the OsMADS8 binary vector.
Figure 6:
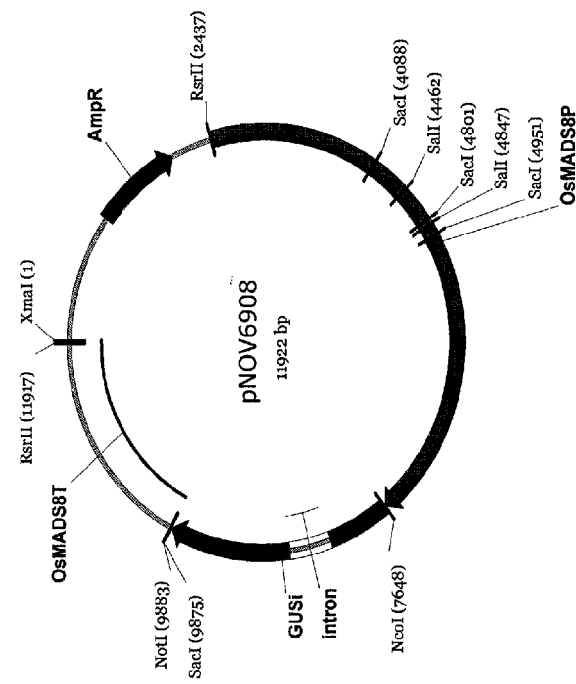
Figure 7:
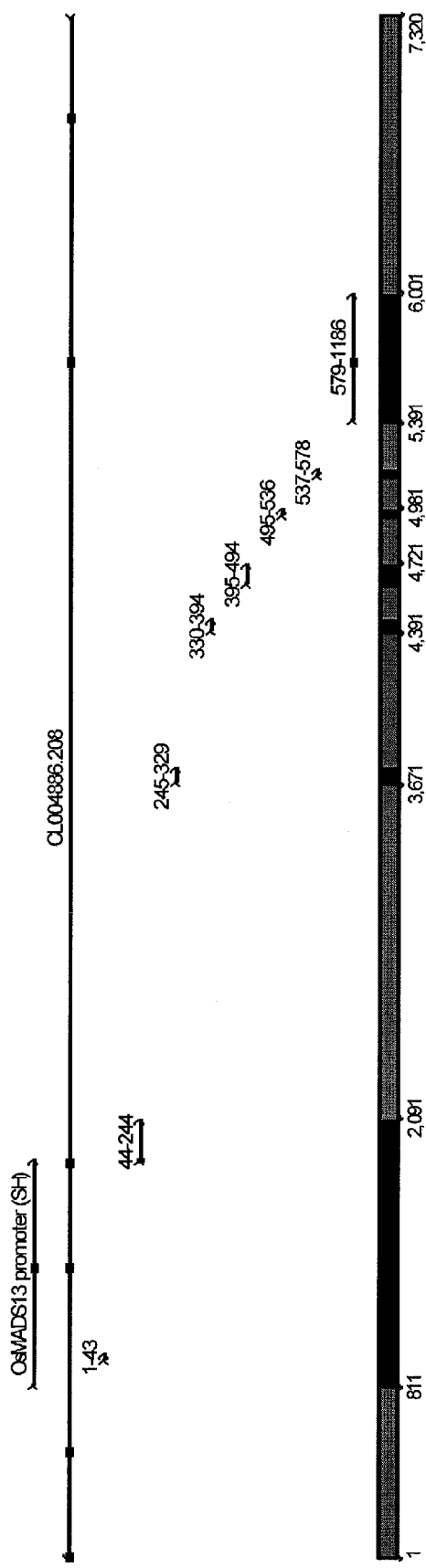
FIG. 7 is a schematic representation of the annotation of the OsMADS13 gDNA with OsMADS13 cDNA sequence.
Figure 8:
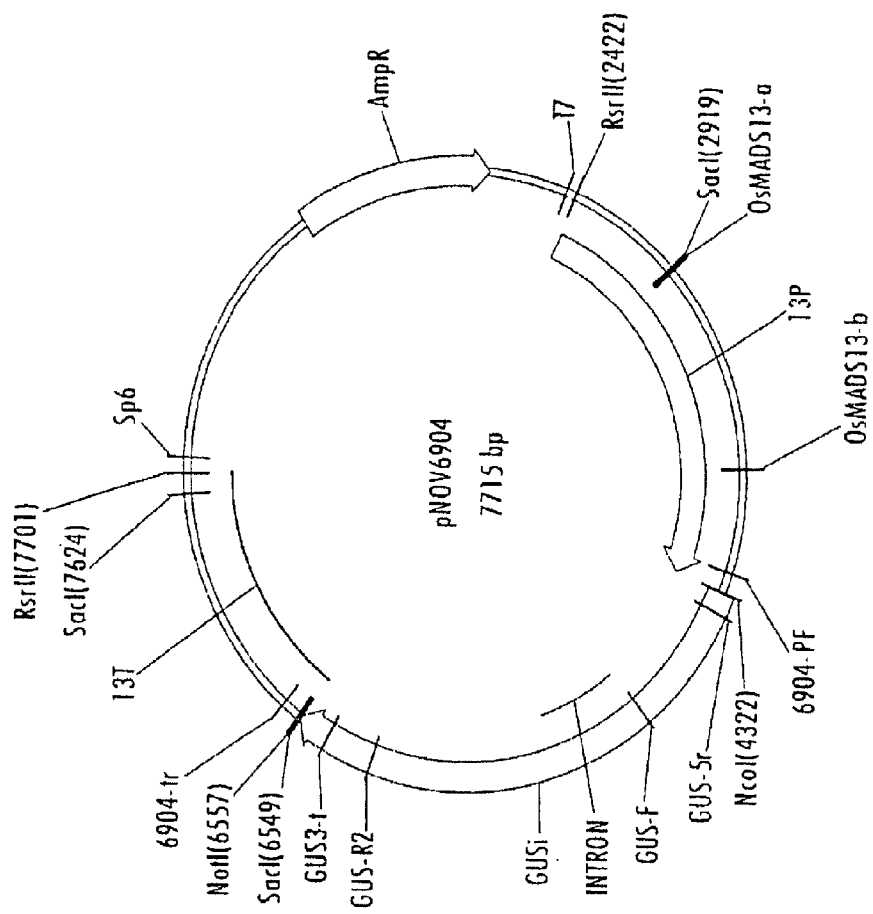
FIG. 8 is a schematic representation of the OsMADS13 Assembly Vector.
Figure 9:
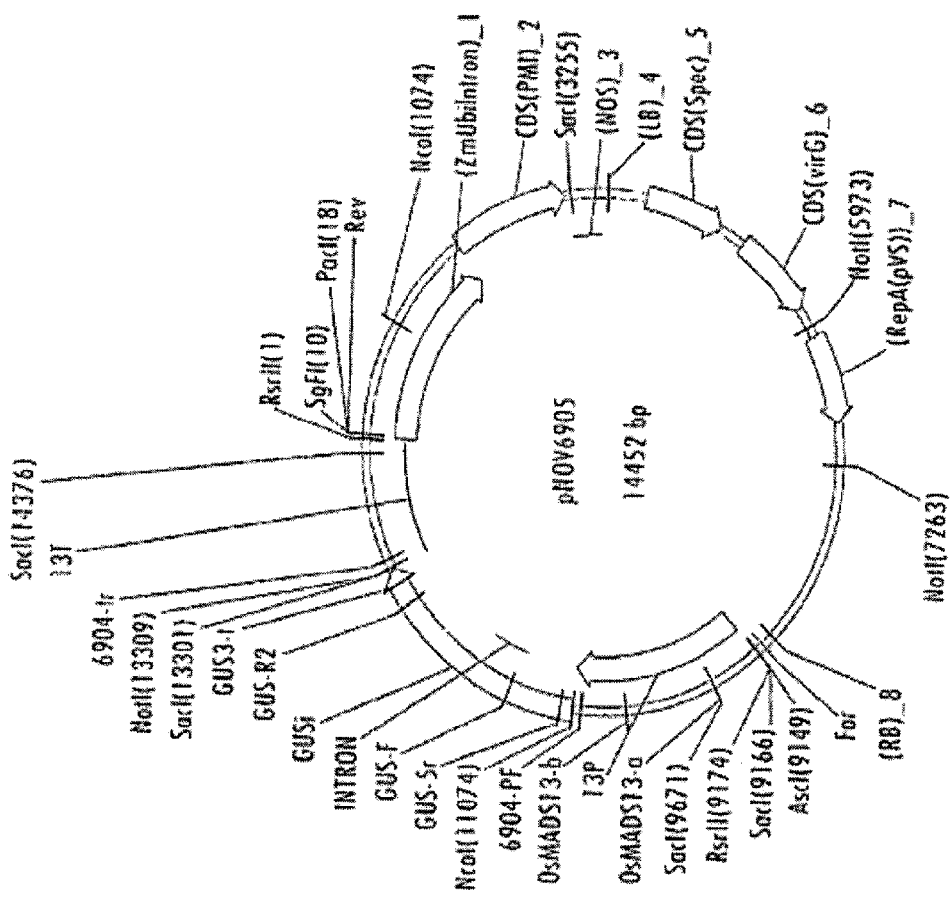
FIG. 9 is a schematic representation of the OsMADS13 Binary Vector.

T1 progeny from three events were sown for expression analysis in vegetative and reproductive tissue. FIGS. 3A and 3B show GUS activity is restricted to developing ears, particularly the vasculature along the outer ear and the transmitting tissue beneath florets. GUS activity is also seen in tissue surrounding the ovule sac. GUS activity was undetectable in the ear node or the node beneath it, tassel, leaf or silk. These results provide further evidence for GUS activity in developing ears. The data show the pattern established at 5 days before pollination persists up to 2 days after pollination. GUS activity becomes restricted to transmitting tissue and maternal tissue at the base of developing kernels during seed development. GUS protein is detectable throughout ovule and kernel development, up to 20 days after pollination. There is very light staining in the aerial tissue, with no GUS activity in the roots In summary, the present invention includes expression cassettes based on the *Oryza sativa* OsMADS5 gene. These cassettes consist of the gene's promoter including the first intron, 5'-UTR, 3'-UTR and 3'-nontranscribed sequence. The cassette's design facilitates replacement of the GUS coding sequence with any gene of interest. The cassette drives gene expression primarily in maternal reproductive tissue. Within developing ears, expression localizes to the outer vasculature along the long axis of the ear, the transmitting tissue in developing florets and kernels, tissue surrounding ovules and maternal tissue at the base of developing kernels. The expression cassettes of the present invention drive gene expression from a very early point in ovule development, perhaps from shortly after differentiation.

EXAMPLE 4

Construction of the OsMADS6 Expression Cassette

A. Cloning of the OsMADS6 5'-Regulatory Sequence
Used high-fidelity PCR to amplify the OsMADS6 5'-regulatory sequence from rice genomic DNA (gDNA). The 50 µL reaction mixture consisted of 100 ng rice gDNA, 200 µM dNTPs, 1 µL 20 µM oligonucleotide primer OsMADS#6-P1 5'-ctaggacgatggtgtgatgtgggaacacg-3' (SEQ ID NO 470), 1 µL 20 µM oligonucleotide primer OsMADS#6-P2 5'-gtac-ctttctaaagtctttgttatgctgcac-3' (SEQ ID NO 471), 1 µL 10× Expand High Fidelity buffer and 1 µL Expand High Fidelity polymerase. The thermocycling program was at 95° C. for 2 minutes followed by 40 cycles of (94° C. for 15 seconds, 68° C. for 7.5 minutes) followed by 68° C. for 10 minutes. Cloned the 4.5 kb OsMADS6-5'-gDNA DNA product with the TOPO XL PCR cloning kit. pCR-XL-TOPO-OsMADS6-5'-gDNA recombinants were identified by digesting 5 µL pCR-XL-TOPO-OsMADS6-5'-gDNA miniprep DNA with EcoRI in a 20 µL reaction mixture containing 2 µg BSA and 2 µL 10× restriction endonuclease buffer. The digests were incubated at 37° C. for 2 hours then the products were resolved on 1% TAE agarose. The positive pCR-XL-TOPO-OsMADS6-5'-gDNA clones were sequenced.

B. Cloning of the OsMADS6 3'-Regulatory Sequence
The OsMADS6 3'-regulatory sequence from rice genomic DNA (gDNA) was amplified using high-fidelity PCR. The 50 µL reaction mixture consisted of 100 ng rice gDNA, 200 µM dNTPs, 1 µL 20 µM oligonucleotide primer OsMADS#6-T1 5'-gctaagcagccatcgatcagctgtcag-3' (SEQ ID NO 470), 1 µL 20 µM oligonucleotide primer OsMADS#6-T2 5'-gatgccat-tgtgtaatgaatggaggagagc-3' (SEQ ID NO 471), 1 µL 10× Expand High Fidelity buffer and 1 µL Expand High Fidelity polymerase. The thermocycling program was at 95° C. for 2 minutes followed by 40 cycles of (94° C. for 15 seconds, 60° C. for 30 seconds, 68° C. for 6 minutes) followed by 68° C. for 15 minutes. The 1.2 kb DNA product was cloned with the Zero Blunt TOPO PCR cloning kit. The pCR-II-Blunt-OsMADS6-3'-gDNA recombinants were identified by digesting 5 µL pCR-II-Blunt-OsMADS6-3'-gDNA miniprep DNA with EcoRI in a 20 µL reaction mixture containing 2 µg BSA and 2 µL 10× restriction endonuclease buffer. The digests were incubated at 37° C. for 2 hours then resolved on 1% TAE agarose. Positive pCR-II-Blunt-OsMADS6-3'-gDNA clones were sequenced.

C. Construction of the OsMADS6 5'-Regulatory Sequence
The OsMADS6 5'-regulatory sequence for the expression cassette was made in several steps. The 3'-half (OsMADS-6Pb, about 2.96 kb) was produced by high-fidelity PCR from the OsMADS6 5'-gene regulatory sequence clone, above. The reaction mixture consisted of 1 µL pCR-XL-TOPO-OsMADS6-5'-gDNA miniprep DNA, 200 µM dNTPs, 20 µM oligonucleotide primer OsMADS6-P3b 5'-cgagtcgacgaggg-gaagagttgagctgag-3' (SEQ ID NO 474), 20 µM oligonucleotide primer OsMADS6-P4c 5'-gactccatggtggttatgctgca-caaaaatg-3' (SEQ ID NO 475), 5 µL 10× cloned Pfu buffer and 2.5 Units of Pfuturbo DNA polymerase (Stratagene, Cat. No. 600252) in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The DNA product was cloned with the Zero Blunt TOPO PCR cloning kit. The pCR-Blunt-II-TOPO-OsMADS6-Pb recombinants were identified by digesting 5 µL pCR-Blunt-II-TOPO-OsMADS6-Pb miniprep DNA with EcoRI in a 20 µL reaction mixture containing 2 µg BSA and 2 µL 10× restriction endonuclease buffer. The digests were incubated at 37° C. for 2 hours then resolved on 1% TAE agarose. Positive pCR-Blunt-II-TOPO-OsMADS6-Pb recombinants were sequenced.

The 5'-half (OsMADS-6 Pa, about 1.5 kb) was produced by high-fidelity PCR from the pCR-XL-TOPO-OsMADS6-5'-gDNA clone, above. The reaction mixture consisted of 1 µL pCR-XL-TOPO-OsMADS6-5'-gDNA miniprep DNA, 200 µM dNTPs, 20 µM oligonucleotide primer OsMADS6-Clb 5'-cagtgcatgcggaccgctaggacgatggtgtgatgtg-3' (SEQ ID NO 476), 20 µM oligonucleotide primer OsMADS6-Paa 5'-cctcgtcgactcgcccgatcgatcgaacg-3' (SEQ ID NO 477), 5 µL 10× cloned Pfu buffer and 2.5 Units of Pfuturbo DNA polymerase in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The 1.5 kb OsMADS6-Pa DNA product was cloned with the Zero Blunt TOPO PCR cloning kit. The pCR-Blunt-II-TOPO-OsMADS6-Pa recombinants were identified by digesting 5 µL pCR-Blunt-II-TOPO-OsMADS6-Pa miniprep DNA with EcoRI in a 20 µL reaction mixture containing 2 µg BSA and 2 µL 10× restriction endonuclease. The digests were incubated at 37° C. for 2 hours then resolved on 1% TAE agarose. Positive pCR-Blunt-II-TOPO-OsMADS6-Pa recombinants were sequenced.

14 µL pCR-Blunt-II-TOPO-OsMADS6-Pb miniprep DNA was digested in a 20 µL reaction mixture containing 2 µg BSA, 2 µL 10× restriction endonuclease buffer, 1 µL SalI and 1 µL NcoI. The digest was incubated at 37° C. for more than 6 hours. The digested DNA was resolved on 1.0% TAE agarose and the 2.96 kb OsMADS6-Pb (SalI/NcoI) DNA band was excised, recovered and ethanol precipitated with glycogen. The OsMADS6-Pb (SalI/NcoI) DNA was recovered by micro centrifugation, washed with 70% ethanol, dried under vacuum and resuspended in 5 µL ddH$_2$O.

2 µg pNOV6901 miniprep DNA was digested in a 20 µL reaction mixture containing 2 µg BSA, 2 µL 10× restriction endonuclease buffer, 1 µL SalI and 1 µL NcoI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The digested plasmid DNA was resolved on 1.0% TAE agarose and the 4.7 kb pNOV6901 (SalI/NcoI/CIP) band was excised, recovered and ethanol precipitated with glycogen. The pNOV6901 (SalI/NcoI/CIP) DNA was recovered by micro centrifugation, washed with 70% ethanol, dried under vacuum and resuspended in 5 µL ddH$_2$O.

4.0 µL OsMADS6-Pb (SalI/NcoI) was ligated to 4.0 µL pNOV6901 (SalI/NcoI/CIP) in a 10 µL ligation mixture containing 1 µL 10× T4 DNA ligase buffer and 1 µL T4 DNA ligase (400 Units/µL). The ligation mixture was incubated for more than 8 hours at 16° C. 5.0 µL of ligation mixture was transformed into 50 µL Top10 competent cells. The recombinants were verified by digesting 2 µL pNOV6901-OsMADS6-Pb miniprep DNA with 0.5 µL SalI, 0.5 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS6-Pb recombinants were sequenced.

2 µg pNOV6901-OsMADS6-Pb miniprep DNA was digested in a 20 µL reaction mixture containing 2 µg BSA, 2 µL 10× restriction endonuclease buffer, 1 µL SalI and 1 µL SphI. The digest was incubated at 37° C. for more than 6 hours, then at 70° C. for 20 minutes. Then 1 µL of the appropriate 10× restriction endonuclease buffer, 1 µL 1 Unit/mL CIP and 8 µL ddH$_2$O were added to the reaction and it was further incubated at 37° C. for 30 minutes. 2 µg pCR-Blunt-II-TOPO-OsMADS6-Pa miniprep DNA was digested in a 20 µL reaction containing 2 µg BSA, 2 µL 10× restriction endonuclease buffer, 1 µL SalI and 1 µL SphI. The digest was incubated at 37° C. for more than 6 hours.

The digested plasmid DNAs, pNOV6901-OsMADS6-Pb (SalI/SphI/CIP) and pCR-Blunt-II-TOPO-OsMADS6-Pa (SalI/SphI), were resolved on 1.0% TAE agarose and the 7.7 kb pNOV6901-OsMADS6-Pb (SalI/SphI/CIP) and the 1.5 kb OsMADS6-Pa (SalI/SphI) bands were excised, recovered and ethanol precipitated with glycogen carrier. The pNOV6901-OsMADS6-Pb (SalI/SphI/CIP) and OsMADS6-Pa (SalI/SphI) DNA fragments were recovered by micro centrifugation, washed with 70% ethanol, dried under vacuum and each resuspended in 5 µL ddH$_2$O.

4.0 µL pNOV6901-OsMADS6-Pb (SalI/SphI/CIP) was ligated to 4.0 µL OsMADS6-Pa (SalI/SphI) in a 10 µL reaction mixture containing 1 µL 10× T4 DNA ligase buffer and 1 µL T4 DNA ligase (400 U/µL). The reaction mixture was incubated for more than 8 hours at 16° C. 5.0 µL of ligation mixture was transformed into 50 µL Top10 competent cells. The pNOV6901-OsMADS6P recombinants were verified by digesting 7.5 µL pNOV6901-OsMADS6P miniprep DNA with 0.5 µL SphI, 0.5 µL NcoI in 10 µL reactions containing 1 µg BSA and 1 µL 10× restriction endonuclease buffer. Digests were incubated at 37° C. for 2 hours then resolved on 1% TAE agarose. Positive pNOV6901-OsMADS6P recombinants were sequenced.

D. Construction of the OsMADS6 3'-Regulatory Sequence

The OsMADS-6 3'-regulatory sequence for the expression cassette, about 1.3 kb, was produced by high-fidelity PCR from the pCR-II-Blunt-OsMADS6-3'-gDNA clone, above. The reaction mixture consisted of 1 µL pCR-II-Blunt-OsMADS6-3'-gDNA miniprep DNA, 200 µM dNTPs, 20 µM oligonucleotide primer OsMADS6-C4b 5'-acgtgagctcgctaagcagccatcgatcag-3' (SEQ ID NO 478), 20 µM oligonucleotide primer OsMADS6-C2 5'-actgcggaccgatgccattgtgtaatgaatgg-3' (SEQ ID NO 479), 5 µL 10× cloned Pfu buffer and 2.5 Units of Pfuturbo DNA polymerase in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The 1.3 kb OsMADS6T DNA product was recovered and ethanol precipitated with glycogen. Recovered the OsMADS6T DNA by micro centrifugation, washed with 70% ethanol, dried under vacuum and resuspended in 14 µL ddH$_2$O. The OsMADS6T DNA was digested in a 20 µL reaction mixture containing 2 µg BSA, 2 µL 10× restriction endonuclease buffer, and 2 µL SmaI. The digest was incubated at 37° C. for more than 6 hours. The OsMADS6T (SmaI) DNA was resolved on 1.0% TAE agarose and the 1.3 kb OsMADS6T (SmaI) band was excised, recovered and ethanol precipitated with glycogen carrier. The OsMADS6T (SmaI) DNA was recovered by micro centrifugation, washed with 70% ethanol, dried under vacuum and resuspended in 5 µL ddH$_2$O.

2 µg pNOV6901-OsMADS6P miniprep DNA was digested in a 20 µL reaction mixture containing 2 µg BSA, 2 µL 10× restriction endonuclease buffer and 2 µL SmaI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901-OsMADS6P (SmaI/CIP) DNA was resolved on 1.0% TAE agarose and the 9.7 kb pNOV6901-OsMADS6P (SmaI/CIP) band was excised, recovered and ethanol precipitated with glycogen carrier. The pNOV6901-OsMADS6P (SmaI/CIP) DNA fragment was recovered by micro centrifugation, washed with 70% ethanol, dried under vacuum and resuspended in 5 µL ddH$_2$O.

4.0 µL pNOV6901-OsMADS6P (SmaI/CIP) was ligated to 4.0 µL OsMADS6T (SmaI) in a 10 µL reaction mixture containing 1 µL 10× T4 DNA ligase buffer and 1 µL T4 DNA ligase (400 Units/µL). The reaction mixture was incubated more than 8 hours at 16° C. 5.0 µL of ligation mixture was transformed into 50 µL Top10 competent cells. The recombinants were verified by digesting 2 µL pNOV6901-OsMADS6P/OsMADS6T miniprep DNA with 1.0 µL RsrII in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS6P/OsMADS6T recombinants were sequenced. Designated the vector pNOV6901-OsMADS6P/OsMADS6T. The plasmid's QC number is 11082. 11082 contains the OsMADS6 expression cassette depicted by SEQ ID NO. 537.

E. Mobilization of the OsMADS6 GUS Expression Cassette into pNOV6900

2 µg pNOV6900 was digested in a 20 µL reaction mixture containing 2 µg BSA, 2 µL 10× restriction endonuclease buffer and 2 µL RsrII. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pNOV6901-OsMADS6P/OsMADS6T miniprep DNA was digested in a 20 µL reaction mixture containing 2 µg BSA, 2 µL 10× restriction endonuclease buffer and 2 µL RsrII. The digest was incubated at 37° C. for more than 6 hours.

The pNOV6900 (RsrII/CIP) and the pNOV6901-OsMADS6P/OsMADS6T (RsrII) plasmid DNAs were resolved on 1.0% TAE agarose, and the 9.2 kb pNOV6900 (RsrII/CIP) and the 8.0 kb pNOV6901-OsMADS6P/OsMADS6T (RsrII) bands were excised, recovered and ethanol precipitated with glycogen carrier. The pNOV6900 (RsrII/CIP) and pNOV6901-OsMADS6P/OsMADS6T (RsrII) DNA fragments were recovered by micro centrifugation, washed with 70% ethanol, dried under vacuum and resuspended in 5 µL ddH$_2$O each.

4.0 µL pNOV6900 (RsrII/CIP) was ligated to 4.0 µL pNOV6901-OsMADS6P/OsMADS6T (RsrII) in a 10 µL ligation mixture containing 1 µL 10× T4 DNA ligase buffer and 1 µL T4 DNA ligase (400 U/µL). The ligation mixture was incubated more than 8 hours at 16° C. 5.0 µL of ligation mixture was transformed into 50 µL Top10 competent cells. The pNOV6900-pNOV6901-OsMADS6P/OsMADS6T recombinants were verified by digesting 2 µL miniprep DNA with 1.0 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6900-pNOV6901-OsMADS6P/OsMADS6T recombinants were sequenced. The finished clone was designated pNOV6907. The plasmid's QC number is 11083.

The engineered alterations in the 5'-regulatory sequence derived from the OsMADS6 gene include introduction of an SphI site followed by an RsrII site at the 5'-end of OsMADS6P, elimination of the natural translation start codon in OsMADS6P, elimination of undesired open reading frames in the new 5'-untranslated leader sequence transcribed from OsMADS6P, insertion of a Kozak sequence upstream of the new translation start codon in OsMADS6P and insertion of the new translation start codon downstream of the intron1/exon2 junction in OsMADS6P as an NcoI site. The engineered alterations in the 3'-gene regulatory sequence derived from the OsMADS6 gene include introduction of a SacI site at the 5'-terminus of OsMADS6T and introduction of an RsrII site at the 3'-terminus of OsMADS6T. In this configuration the GUS coding sequence can be replaced with any gene of interest flanked by NcoI/NotI or NcoI/SacI restriction sites. The complete cassette is mobilized, as an RsrII fragment, to the binary vector pNOV6900.

The cassette was transformed into A188 X HyII maize and Kaybonnet rice using standard *agrobacterium* mediated methodology.

GUS Expression in T0 Maize

One hundred-two T0 transgenic maize lines were generated. Tassel spikelets were histochemically screened for GUS activity. Sixty-four events were positive for GUS activity in the tassel glume, and some also stained positive at the spikelet base. Fifty-six also showed GUS expression in leaf punches. Ears from several plants were sacrificed to examine GUS expression in developing florets. GUS activity localizes primarily to vascular bundles in developing ears, which appears connected to transmitting tissue in each floret. These data indicate the cassette drives GUS expression primarily in female reproductive tissue.

GUS Expression in T0 Rice

Forty-one T0 rice lines containing pNOV6907 were generated. Twenty independent transformants were histochemically stained for GUS expression. Light to strong GUS activity was detected in leaf tissue. In most events, activity in spikelets localized to glumes. Staining intensity varied significantly. Seed were collected for each line, but were not further analyzed.

GUS Expression in T1 Maize

T1 progeny from two independent transformants were sown and analyzed in detail for GUS expression. There was no detectable GUS expression in silk, leaf and tassel. This indicates tassel and leaf expression observed in T0 plants may result from tissue culture associated with the transformation process. Dissected organs from T1 tassel spikelets had no apparent GUS activity (data not shown). GUS activity is seen in the ear node and the developing ear shoot. Residual GUS activity is seen in the central pith, and most activity in the developing ear shoot. Ear activity is confined to the node, the outer whorls and the central region. The pith beneath the ear node has no detectable GUS activity. GUS activity is seen in ears from 8 to 2 days prior to pollination. As in T0 ears, activity is confined to the, florets and transmitting tissue. Post-pollination GUS activity remains confined to the same tissues. Activity in developing kernels appears restricted to maternal tissue. This pattern persists through kernel development. No activity is detected in the endosperm or developing embryo, it localizes to the placental, funicular and hilar regions of developing kernels. GUS protein is detectable throughout ovule and kernel development, up to 20 days after pollination. These data support the OsMADS6 cassette as a very good candidate for trait expression in developing florets and kernels. When driven by the OsMADS6-based expression cassette, genes that facilitate phloem unloading such as invertase or a sucrose transporter should prove effective in supporting early ear development by increasing sink strength. There is very light or no staining in the aerial tissue, with no GUS activity in the roots One embodiment of the invention is an expression cassette based on the *Oryza sativa* OsMADS6 gene. The expression cassette consists of the gene's promoter including the first intron, 5'-UTR, 3'-UTR and 3'-nontranscribed sequence. These components were assembled into a GUS expression cassette and tested in transgenic plants. The cassette's design facilitates replacement of the GUS coding sequence with any gene of interest. The expression cassette drives gene expression primarily in maternal reproductive tissue. Within developing ears, expression localizes to florets, maternal components of developing kernels, the placental or transmitting tissue and vasculature. The expression cassettes of the present invention further drive gene expression from a very early point in ovule development, perhaps from shortly after differentiation.

EXAMPLE 5

Construction of the OsMADS8 Expression Cassette

A. Cloning of the OsMADS8 5'-Regulatory Sequence

The OsMADS8 5'-regulatory sequence from rice genomic DNA (gDNA) was amplified using high-fidelity PCR. The 50 µL reaction mixture consisted of 100 ng rice gDNA, 200 µM dNTPs, 1 µL 20 µM oligonucleotide primer OsMADS8.P1 5'-ggtatctttccaaagttctggtcatgctgc-3' (SEQ ID NO 522), 1 µL 20 µM oligonucleotide primer OsMADS8.P2 5'-ccatttttgcgaaatgccaaatcctggc-3' (SEQ ID NO 523), 1 µL 10× Expand High Fidelity buffer and 1 µL Expand High Fidelity polymerase. The thermocycling program was at 95° C. for 2 minutes followed by 40 cycles of (94° C. for 15 seconds, 68° C. for 7.5 minutes) followed by 68° C. for 10 minutes. The 5.2 kb OsMADS8-5'-gDNA DNA product was cloned with the TOPO XL PCR cloning kit. The pCR-XL-TOPO-OsMADS8-5'-gDNA was identified by digesting 5 µL pCR-XL-TOPO-OsMADS8-5'-gDNA miniprep DNA with EcoRI in a 20 µL reaction mixture containing 2 µg BSA and 2 µL 10× restriction endonuclease buffer. The digests were incubated at 37° C. for 2 hours then resolved on 1% TAE agarose. Positive pCR-XL-TOPO-OsMADS8-5'-gDNA clones were sequenced.

B. Cloning of the OsMADS8 3'-Regulatory Sequence

The OsMADS8 3'-regulatory sequence from rice genomic DNA (gDNA) was amplified using high-fidelity PCR. The 50 µL reaction mixture consisted of 100 ng rice gDNA, 200 µM dNTPs, 1 µL 20 µM oligonucleotide primer OsMADS8.T1 5'-acgtgagctcactcctgaaggccgatgcgacaacc-3' (SEQ ID NO 480), 1 µL 20 µM oligonucleotide primer OsMADS8.T2 5'-agtcatcgatcatgacaaaatatcatgtttatttcgagg-3' (SEQ ID NO 481), 1 µL 10× Expand High Fidelity buffer and 1 µL Expand High Fidelity polymerase. The thermocycling program was 95° C. for 2 minutes followed by 40 cycles of (94° C. for 15 seconds, 60° C. for 30 seconds, 68° C. for 6 minutes) followed by 68° C. for 15 minutes. Cloned the 2.04 kb OsMADS8-3'-gDNA DNA product with the Zero Blunt TOPO PCR cloning kit. The pCR-Blunt-II-OsMADS8-3'-gDNA recombinants were identified by digesting 5 µL miniprep DNA with EcoRI in a 20 µL reaction mixture containing 2 µg BSA and 2 µL 10× restriction endonuclease buffer. The digests were incubated at 37° C. for 2 hours then resolved on 1% TAE agarose. Positive pCR-Blunt-II-OsMADS8-3'-gDNA clones were sequenced.

C. Construction of the OsMADS8 5'-Regulatory Sequence

The OsMADS8 5'-regulatory sequence for the expression cassette was made in several steps. The 3'-half (OsMADS- 8Pb, about 2.8 kb) was produced by high-fidelity PCR from pCR-XL-TOPO-OsMADS8-5'-gDNA, above. The reaction mixture consisted of 1 µL pCR-XL-TOPO-OsMADS8-5'-gDNA miniprep DNA, 200 µM dNTP mixture, 20 µM oligonucleotide primer OsMADS8-Pcc 5'-atcgccatggtggtcaagctg-caagtttcaaaaacac-3' (SEQ ID NO 482), 20 µM oligonucleotide primer OsMADS8-C3 5'-acgtgtcgacgagagg-gagggtgga-3' (SEQ ID NO 483), 5 µL 10× cloned Pfu buffer and 2.5 Units of Pfuturbo DNA polymerase in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The 2.8 kb OsMADS-8Pb DNA product was cloned with the Zero Blunt TOPO PCR cloning kit. The pCR-Blunt-II-TOPO-OsMADS-8Pb recombinants were identified by digesting 5 µL pCR-Blunt-II-TOPO-OsMADS-8Pb miniprep DNA with EcoRI in a 20 µL reaction mixture containing 2 µg BSA and 2 µL 10× restriction endonuclease buffer. Digests were incubated at 37° C. for 2 hours then resolved on 1% TAE agarose. Positive pCR-Blunt-II-TOPO-OsMADS-8Pb clones were sequenced.

The 5'-half (OsMADS-8 Pa, about 2.4 kb) was produced by high-fidelity PCR from pCR-XL-TOPO-OsMADS8-5'-gDNA, above. The reaction mixture consisted of 1 µL pCR-XL-TOPO-OsMADS8-5'-gDNA miniprep DNA, 200 µM dNTP mixture, 20 µM oligonucleotide primer OsMADS8-C5b 5'-tcctcctcctcctcctccacctcacct-3' (SEQ ID NO 484), 20 µM oligonucleotide primer OsMADS8-Clb 5'-aactaaatcgcct-gcaggcggaccgttttttgcgaaatgcc-3' (SEQ ID NO 485), 5 µL 10× cloned Pfu buffer and 2.5 Units of Pfuturbo DNA polymerase in a final volume of 50 µL. The thermocycling program was at 95° C. for 30 seconds then 40 cycles of (95° C. for 10 seconds, 50° C. for 60 seconds, 72° C. for 6 minutes) then 72° C. for 10 minutes. The 2.4 kb OsMADS-8 Pa DNA product was cloned with the Zero Blunt TOPO PCR cloning kit. The pCR-Blunt-II-TOPO-OsMADS-8 Pa recombinants were identified by digesting 5 µL pCR-Blunt-II-TOPO-OsMADS-8 Pa miniprep DNA with EcoRI in a 20 µL reaction mixture containing 2 µg BSA and 2 µL 10× restriction endonuclease buffer. Digests were incubated at 37° C. for 2 hours then resolved on 1% TAE agarose. Positive pCR-Blunt-II-TOPO-OsMADS-8Pb clones were sequenced.

14 µL pCR-Blunt-II-TOPO-OsMADS-8Pb miniprep DNA was digested in a 20 µL reaction mixture containing 2 µg BSA, 2 µL 10× restriction endonuclease buffer, 1 µL SalI and 1 µL NcoI. The digest was incubated at 37° C. for more than 6 hours. The pCR-Blunt-II-TOPO-OsMADS-8Pb (SalI/NcoI) DNA was resolved on 1.0% TAE agarose and the 2.96 kb OsMADS-8Pb (SalI/NcoI) band was excised, recovered and ethanol precipitated with glycogen carrier. OsMADS-8Pb (SalI/NcoI) DNA was recovered by micro centrifugation, washed with 70% ethanol, dried under vacuum and resuspended in 5 µL ddH$_2$O.

2 µg pNOV6901 miniprep DNA was digested in a 20 µL reaction mixture containing 2 µg BSA, 2 µL 10× restriction endonuclease buffer, 1 µL SalI and 1 µL NcoI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901 (SalI/NcoI/CIP) plasmid DNA was resolved on 1.0% TAE agarose and the 4.7 kb pNOV6901 (SalI/NcoI/CIP) DNA band was excised, recovered and ethanol precipitated with glycogen carrier. The pNOV6901 (SalI/NcoI/CIP) DNA was recovered by micro centrifugation, washed with 70% ethanol, dried under vacuum and resuspended in 5 µL ddH$_2$O.

4.0 µL OsMADS-8Pb (SalI/NcoI) was ligated to 4.0 µL pNOV6901 (SalI/NcoI/CIP) in a 10 µL reaction mixture containing 1 µL 10× T4 DNA ligase buffer and 1 µL T4 DNA ligase (400 Units/µL), which was incubated more than 8 hours at 16° C. 5.0 µL of ligation mixture was transformed into 50 µL Top10 competent cells. The pNOV6901-OsMADS-8Pb recombinants were verified by digesting 2 µL pNOV6901-OsMADS-8Pb miniprep DNA with 0.5 µL SalI, 0.5 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS-8Pb recombinants were sequenced.

An SbfI restriction site was introduced to pNOV6901-OsMADS-8Pb by ligating Synthetic Adapter III to the construct. Synthetic Adapter III was made by combining 40 µL of 50 µM oligonucleotide 8PA-1 5'-Pggagatcggg-3' (SEQ ID NO 486), 40 µL of 50 µM oligonucleotide 8PA-2 5'-Ptcgac-ccgatcacc-3' (SEQ ID NO 487)—where P is a 5'-phosphate group—in a 100 µL mixture that is 25 mM in Tris-HCl (pH 8.0) and 10 mM in MgCl$_2$. The mixture was boiled for 5 minutes, removed from heat and naturally cooled to room temperature (about 60 minutes). This yielded a 20 µM Synthetic Adapter III mixture.

pNOV6901-OsMADS-8Pb was prepared by digesting 14 µL pNOV6901-OsMADS-8Pb miniprep DNA with 2 µL SalI in a 20 µL reaction mixture containing 2 µg BSA and 2 µL 10× restriction endonuclease buffer. The digest was incubated at 37° C. for 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901-OsMADS-8Pb (SalI/CIP) DNA was resolved on 1% TAE agarose, excised, recovered and ethanol precipitated with glycogen carrier. The pNOV6901-OsMADS-8Pb (SalI/CIP) DNA was recovered by micro centrifugation, washed with 70% ethanol, dried under vacuum and resuspended in 5 µL ddH$_2$O.

4.5 µL Synthetic Adapter III mixture was ligated to 2.5 µL pNOV6901-OsMADS-8Pb (SalI/CIP) in a 10 µL ligation mixture containing 1 µL 10× T4 DNA ligase buffer and 1 µL T4 DNA ligase (400 U/µL), which was incubated more than 8 hours at 16° C. 4 µL of ligation mixture was transformed into 50 µL XL-1 supercompetent cells (Stratagene, Cat. No. 200236). The pNOV6901-OsMADS-8Pb-SbfI recombinants were verified by digesting 7.5 µL pNOV6901-OsMADS-8Pb-SbfI miniprep DNA in a 10 µL reaction mixture containing 1 µg BSA, 1 µL 10× restriction endonuclease buffer and 1 µL SalI. The digests were incubated at 37° C. for 2 hours then resolved on 1.0% TAE agarose. The pNOV6901-OsMADS-8Pb-SbfI recombinants that lost the SalI restriction site were digested with SbfI in a 10 µL reaction mixture containing 1 µg BSA, 1 µL 10× SEBuffer Y restriction endonuclease buffer and 1 µL SbfI (New England Biolabs). The digests were incubated at 37° C. for 2 hours then resolved on 1.0% TAE agarose. Positive pNOV6901-OsMADS-8Pb-SbfI recombinants were sequenced.

2 µg pNOV6901-OsMADS-8Pb-SbfI miniprep DNA was digested in a 20 µL reaction mixture containing 2 µg BSA, 2 µL 10× restriction endonuclease buffer and 2 µL SbfI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pCR-Blunt-II-TOPO-OsMADS-8 Pa miniprep DNA was digested in a 20 µL reaction mixture containing 2 µg BSA, 2 µL 10× restriction endonuclease buffer and 2 µL SbfI. The digest was incubated at 37° C. for more than 6 hours.

The digested plasmid DNAs, pNOV6901-OsMADS-8Pb-SbfI (SbfI/CIP) and pCR-Blunt-II-TOPO-OsMADS-8 Pa (SbfI), were resolved on 1.0% TAE agarose and the 7.5 kb pNOV6901-OsMADS-8Pb (SbfI/CIP) and the 2.4 kb OsMADS-8 Pa (SbfI) bands were excised, recovered and ethanol precipitated with glycogen carrier. The DNA fragments were recovered by micro centrifugation, washed with 70% ethanol, dried under vacuum and each resuspended in 5 µL ddH$_2$O.

4.0 µL pNOV6901-OsMADS-8Pb (SbfI/CIP) was ligated to 4.0 µL OsMADS-8 Pa (SbfI) in a 10 µL ligation mixture containing 1 µL 10× T4 DNA ligase buffer and 1 µL T4 DNA ligase (400 U/µL), which was incubated for more than 8 hours at 16° C. 5.0 µL of ligation mixture was transformed into 50 µL Top10 competent cells. The pNOV6901-OsMADS-8P recombinants were verified by digesting 7.5 µL pNOV6901-OsMADS-8P miniprep DNA with 0.5 µL SbfI, 0.5 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS-8P recombinants were sequenced.

D. Construction of the OsMADS8 3'-Regulatory Sequence

The OsMADS-8 3'-regulatory sequence for the expression cassette, about 2.1 kb, was produced by high-fidelity PCR from the pCR-Blunt-II-OsMADS8-3'-gDNA clone, above. The reaction mixture consisted of 1 µL pCR-Blunt-II-OsMADS8-3'-gDNA miniprep DNA, 200 µM dNTP mixture, 20 µM oligonucleotide primer OsMADS8-C2 5'-acgtc-ccgggcggaccgagtcatcgatcatgac-3' (SEQ ID NO 488), 20 µM oligonucleotide primer OsMADS8-C4 5'-tcgagcggccgcag-gccgatgcgacaaccaataaaaac-3' (SEQ ID NO 489), 5 µL 10× cloned Pfu buffer and 2.5 Units of Pfuturbo DNA polymerase (Stratagene, Cat. No. 600252) in a final volume of 50 µL. The thermocycling program was 95° C. for 30 seconds then 40 cycles of (95° C. for 10 seconds, 50° C. for 60 seconds, 72° C. for 6 minutes) then 72° C. for 10 minutes. The OsMADS-8T DNA product was recovered using the QIAquick PCR purification kit. The recovered OsMADS-8T DNA was ethanol precipitated with glycogen carrier. The OsMADS-8T DNA was recovered by micro centrifugation, washed with 70% ethanol, dried under vacuum and resuspended in 14 µL ddH$_2$O. The OsMADS-8T DNA was digested in a 20 µL reaction mixture containing 2 µg BSA, 2 µL 10× restriction endonuclease buffer, 1 µL NotI and 1 µL XmaI. The digest was incubated at 37° C. for more than 6 hours. The OsMADS-8T (NotI/XmaI) DNA was resolved on 1.0% TAE agarose, excised, recovered and ethanol precipitated with glycogen carrier. The OsMADS-8T (NotI/XmaI) DNA was recovered by micro centrifugation, washed with 70% ethanol, dried under vacuum and resuspended in 5 µL ddH$_2$O.

2 µg pNOV6901-OsMADS-8P miniprep DNA was digested in a 20 µL reaction mixture containing 2 µg BSA, 2 µL 10× restriction endonuclease buffer, 1 µL NotI and 1 µL XmaI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901-OsMADS-8P (NotI/XmaI/CIP) plasmid DNA was resolved on 1.0% TAE agarose and the 9.9 kb pNOV6901-OsMADS-8P band was excised, recovered and ethanol precipitated with glycogen carrier. The pNOV6901-OsMADS-8P (NotI/XmaI/CIP) DNA fragment was recovered by micro centrifugation, washed with 70% ethanol, dried under vacuum and resuspended in 5 µL ddH$_2$O.

4.0 µL of the pNOV6901-OsMADS-8P (NotI/XmaI/CIP) was ligated to 4.0 µL OsMADS-8T (NotI/XmaI) in a 10 µL ligation mixture containing 1 µL 10× T4 DNA ligase buffer and 1 µL T4 DNA ligase (400 Units/µL), which was incubated more than 8 hours at 16° C. 5.0 µL of ligation mixture was transformed into 50 µL Top10 competent cells. pNOV6901-OsMADS-8P/OsMADS-8T recombinants were verified by digesting 2 µL pNOV6901-OsMADS-8P/OsMADS-8T miniprep DNA with 1.0 µL RsrII in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS-8P/OsMADS-8T recombinants were sequenced. The finished clone was designated pNOV6901-OsMADS-8P/OsMADS-8T. The plasmid's QC number is 11170. 11170 contains the complete OSMADS8 expression cassette depicted by SEQ ID NO. 538.

E. Mobilization of the OsMADS8 GUS Expression Cassette into pNOV6900

2 µg pNOV6900 was digested in a 20 µL reaction mixture containing 2 µg BSA, 2 µL 10× restriction endonuclease buffer and 2 µL RsrII. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pNOV6901-OsMADS-8P/OsMADS-8T miniprep DNA was digested in a 20 µL reaction mixture containing 2 µg BSA, 2 µL 10× restriction endonuclease buffer and 2 µL RsrII. The digest was incubated the reaction at 37° C. for more than 6 hours.

The digested plasmid DNAs, pNOV6900 (RsrII/CIP) and pNOV6901-OsMADS-8P/OsMADS-8T (RsrII), were resolved on 1.0% TAE agarose and the 9.2 kb pNOV6900 (RsrII/CIP) and the 9.5 kb pNOV6901-OsMADS-8P/OsMADS-8T (RsrII) bands were excised, recovered and ethanol precipitated with glycogen carrier. The pNOV6900 (RsrII/CIP) and the pNOV6901-OsMADS-8P/OsMADS-8T (RsrII) DNA fragments were recovered by micro centrifugation, washed with 70% ethanol, dried under vacuum and each resuspended in 5 µL ddH$_2$O.

4.0 µL of pNOV6900 (RsrII/CIP) was ligated to 4.0 µL pNOV6901-OsMADS-8P/OsMADS-8T (RsrII) in a 10 µL ligation mixture containing 1 µL 10× T4 DNA ligase buffer and 1 µL T4 DNA ligase (400 U/µL). The ligation mixture was incubated more than 8 hours at 16° C. 5.0 µL of ligation mixture was transformed into 50 µL Top10 competent cells. The pNOV6900-pNOV6901-OsMADS-8P/OsMADS-8T recombinants were verified by digesting 7.5 µL pNOV6900-pNOV6901-OsMADS-8P/OsMADS-8T miniprep DNA with 1.0 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6900-pNOV6901-OsMADS-8P/OsMADS-8T recombinants were sequenced. The finished clone was designated pNOV6909. The plasmid's QC number is 11171.

The engineered alterations in the 5'-regulatory sequence derived from the OsMADS8 gene include introduction of an SbfI site followed by an RsrII site at the 5'-end of OsMADS8P, elimination of the natural translation start codon in OsMADS8P, elimination of undesired open reading frames in the new 5'-untranslated leader sequence transcribed from OsMADS8P, insertion of a Kozak sequence upstream of the new translation start codon in OsMADS8P and insertion of the new translation start codon downstream of the intron1/exon2 junction in OsMADS8P as an NcoI site. The engineered alterations in the 3'-gene regulatory sequence derived from the OsMADS8 gene include introduction of a NotI site at the 5'-terminus of OsMADS8T and introduction of an RsrII site at the 3'-terminus of OsMADS8T. In this configuration the GUS coding sequence can be replaced with any gene of interest flanked by NcoI/NotI restriction sites. The complete cassette is mobilized, as an RsrII fragment, to the binary vector pNOV6900.

The cassette was transformed into A188 X HyII maize and Kaybonnet rice using standard *agrobacterium* mediated methodology.

GUS Expression in T0 Maize

Forty T0 transgenic maize lines were generated. Tassel spikelets were histochemically screened for GUS activity. Twenty-nine events were positive for GUS activity. Thirteen also showed GUS expression in leaf punches. In general, the pattern revealed detectable GUS activity in tassels and little of no activity in leaf punches. The ear from one plant reflecting this pattern was sacrificed to examine GUS expression. Strong GUS expression is evident throughout the ear. These data indicate the cassette drives GUS expression primarily in female reproductive tissue.

GUS Expression in T0 Rice

Of thirty-six T0 rice lines containing pNOV6909, thirty-two independent transformants were histochemically stained for GUS expression. No GUS activity was detected in leaf tissue. In most events, activity localized to panicles and could be seen in anthers or the carpel base. Staining intensity varied significantly.

GUS Expression in T1 Maize

T1 progeny from four independent transformants were sown and analyzed in detail for GUS expression. There was no detectable GUS expression in tassels, leaf tissue, developing silk or shoots. This indicates tassel and leaf expression observed in T0 plants may result from tissue culture associated with the transformation process. Dissected organs from T1 tassels indicated no apparent GUS expression (data not shown). There is no GUS activity in the node attached to the developing ear shoot. The node below this also has no detectable GUS activity, but there is distinct activity in florets on the arrested ear. The expression cassette is activated very early in floret development. GUS activity is seen in the central pith and florets of the developing ear before pollination. This pattern persists from 5 days before pollination to one day before pollination. Central pith expression persists up to 1 day before pollination, after which GUS activity is no longer detected in this zone. There is some GUS activity in the ear's outer vasculature and the floret's transmitting tissue from the day of pollination to 1 day after pollination. Afterwards, GUS activity is detected only in the maternal components of developing kernels. GUS protein is detectable throughout ovule and kernel development, up to 20 days after pollination. These data support the OsMADS8 cassette as a very good candidate for trait expression in developing florets. When driven by the OsMADS8-based expression cassette, genes that facilitate phloem unloading such as invertase or a sucrose transporter should prove effective in supporting early ear development by increasing sink strength. There is very light staining in the aerial tissue, with no GUS activity in the roots In summary, the present invention includes expression cassettes based on the *Oryza sativa* OsMADS8 gene. It consists of the gene's promoter including the first intron, 5'-UTR, 3'-UTR and 3'-nontranscribed sequence. The cassette's design facilitates replacement of the GUS coding sequence with any gene of interest. The cassette targets gene expression primarily to developing florets and kernels, and the placental tissue beneath each floret. Post-fertilization, expression is detected in the aleurone, hilar region and pedicel. Developmentally, the cassette should drive gene expression from a very early point in ovule development, perhaps from shortly after differentiation.

EXAMPLE 6

Construction of the OsMADS13 Expression Cassette

A. Cloning of the OsMADS13 5'-Regulatory Sequence

The OsMADS13 5'-regulatory sequence from rice genomic DNA (gDNA) was amplified using high-fidelity PCR. The 50 µL reaction mixture consisted of 100 ng rice gDNA, 200 µM dNTPs, 1 µL 20 µM oligonucleotide primer OsMADS13-C1 5'-gactgcatgcggaccgttccaaaat-taagcacacacatttg-3' (SEQ ID NO 490), 1 µL 20 µM oligonucleotide primer OsMADS13-C2 5'-gactccatggcttcttgctct-caactgatcaac-3' (SEQ ID NO 491), 1 µL 10× Expand High Fidelity buffer and 1 µL Expand High Fidelity polymerase. The thermocycling program was at 95° C. for 2 minutes followed by 40 cycles of (94° C. for 15 seconds, 68° C. for 7.5 minutes) followed by 68° C. for 10 minutes. The 1.9 kb OsMADS13-5'-gDNA DNA fragment was recovered and ethanol precipitated with glycogen carrier. The OsMADS13-5'-gDNA fragment was recovered by micro centrifugation, washed with 70% ethanol, dried under vacuum and resuspended in 14 µL ddH$_2$O. The OsMADS13-5'-gDNA fragment was digested in a 20 µL reaction mixture containing 2 µg BSA, 2 µL 10× restriction endonuclease buffer and 2 µL NcoI. The digest was incubated at 37° C. for more than 6 hours. The digest was resolved on 1.0% TAE agarose and the 1.9 kb OsMADS13-5'-gDNA (NcoI) DNA band was excised, recovered and ethanol precipitated with glycogen carrier. The OsMADS13-5'-gDNA (NcoI) DNA as recovered by micro centrifugation, washed with 70% ethanol, dried under vacuum and resuspended in 5 µL ddH$_2$O.

2 µg pNOV6901 miniprep DNA was digested in a 20 µL reaction mixture containing 2 µg BSA, 2 µL 10× restriction endonuclease buffer and 2 µL SphI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901 (SphI/blunt) DNA was resolved on 1.0% TAE agarose and the 4.7 kb pNOV6901 (SphI/blunt) band was excised, recovered and ethanol precipitated with glycogen carrier. The pNOV6901 (SphI/blunt) DNA was recovered by micro centrifugation, washed with 70% ethanol, dried under vacuum and resuspended in 14 µL ddH$_2$O.

pNOV6901 (SphI/blunt) miniprep DNA was digested in a 20 µL reaction mixture containing 2 µg BSA, 2 µL 10× restriction endonuclease buffer and 2 µL NcoI. The digest was incubated at 37° C. for more than 6 hours. The pNOV6901 (SphI/blunt/NcoI) plasmid DNA was resolved on 1.0% TAE agarose and the 4.7 kb pNOV6901 (SphI/blunt/NcoI) band was excised, recovered and ethanol precipitated with glycogen carrier. The pNOV6901 (SphI/blunt/NcoI) DNA was recovered by micro centrifugation, washed with 70% ethanol, dried under vacuum and resuspended in 5 µL ddH$_2$O.

4.0 µL OsMADS13-5'-gDNA (NcoI) was ligated to 4.0 µL pNOV6901 (SphI/blunt/NcoI) in a 10 µL ligation mixture containing 1 µL 10× T4 DNA ligase buffer and 1 µL T4 DNA ligase (400 Units/µL). The ligation mixture was incubated more than 8 hours at 16° C. 5.0 µL of the ligation mixture was transformed into 50 µL Top10 competent cells. The pNOV6901-OsMADS13P recombinants were verified by digesting 2 µL pNOV6901-OsMADS13P miniprep DNA with 0.5 µL XhoI, 0.5 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6901-OsMADS13P recombinants were sequenced.

B. Cloning of the OsMADS13 3'-Regulatory Sequence

The OsMADS13 3'-regulatory sequence from rice genomic DNA (gDNA) was amplified using high-fidelity PCR. The 50 µL reaction mixture consisted of 100 ng rice gDNA, 200 µM dNTPs, 1 µL 20 µM oligonucleotide primer OsMADS13-C3 5'-tcgagcggccgctgacatggatatgatgatcag-3' (SEQ ID NO 492), 1 µL 20 µM oligonucleotide primer OsMADS13-C4 5'-acgtatcgatcggaccgcaacgcacgggcacccaac-3' (SEQ ID NO 493), 1 µL 10× Expand High Fidelity buffer and 1 µL Expand High Fidelity polymerase. The thermocycling program was at 95° C. for 2 minutes followed by 40 cycles of (94° C. for 15 seconds, 60° C. for 30 seconds, 68° C. for 6 minutes) followed by 68° C. for 15 minutes. The 1.2 kb OsMADS13-3'-gDNA DNA fragment was recovered and ethanol precipitated with glycogen carrier. The OsMADS13-3'-gDNA DNA fragment was recovered by micro centrifugation, washed with 70% ethanol, dried under vacuum and resuspended in 14 µL ddH$_2$O.

The OsMADS13-3'-gDNA fragment was digested in a 20 µL reaction mixture containing 2 µg BSA, 2 µL 10× restriction endonuclease buffer and 2 µL NotI. The digest was incubated at 37° C. for more than 6 hours then resolved on 1.0% TAE agarose and the 1.2 kb OsMADS13-3'-gDNA (NotI) DNA band was excised, recovered and ethanol precipitated with glycogen carrier. The OsMADS13-3'-gDNA (NotI) DNA was recovered by micro centrifugation, washed with 70% ethanol, dried under vacuum and resuspended in 5 µL ddH$_2$O.

2 µg pNOV6901-OsMADS13P miniprep DNA was digested in a 20 µL reaction mixture containing 2 µg BSA, 2 µL 10× restriction endonuclease buffer, 1 µL NotI and 1 µL SmaI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The pNOV6901-OsMADS13P (NotI/SmaI/CIP) DNA was resolved on 1.0% TAE agarose and the 6.6 kb band was excised, recovered and ethanol precipitated with glycogen carrier. The pNOV6901-OsMADS13P (NotI/SmaI/CIP) DNA fragment was recovered by micro centrifugation, washed with 70% ethanol, dried under vacuum and resuspended each in 5 µL ddH$_2$O.

4.0 µL pNOV6901-OsMADS13P (NotI/SmaI/CIP) was ligated to 4.0 µL OsMADS13-3'-gDNA (NotI) in a 10 µL ligation mixture containing 1 µL 10× T4 DNA ligase buffer and 1 µL T4 DNA ligase (400 Units/µL). The ligation mixture was incubated more than 8 hours at 16° C. 5.0 µL of the ligation mixture was transformed into 50 µL Top10 competent cells. The pNOV6901-OsMADS13P/OsMADS13T recombinants were verified by digesting 7.5 µL pNOV6901-OsMADS13P/OsMADS13T miniprep DNA with 1.0 µL NotI in 10 µL reaction mixtures containing 1 µg BSA and 1 µL 10× restriction endonuclease buffer. Digests were incubated at 37° C. for 2 hours then resolved on 1% TAE agarose. Positive pNOV6901-OsMADS13P/OsMADS13T recombinants were sequenced. The finished clone was designated pNOV6904, which is also the plasmid's QC number. pNOV6904 contains the complete OSMAD13 expression cassette depicted by SEQ ID NO. 539.

C. Mobilization of the OsMADS13 GUS Expression Cassette into pNOV6900

2 µg pNOV6900 was digested in a 20 µL reaction mixture containing 2 µg BSA, 2 µL 10× restriction endonuclease buffer and 2 µL RsrII. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pNOV6901-OsMADS13P/OsMADS13T miniprep DNA was digested in a 20 µL reaction mixture containing 2 µg BSA, 2 µL 10× restriction endonuclease buffer and 2 µL RsrII. The digest was incubated the reaction at 37° C. for more than 6 hours.

The digested plasmid DNAs, pNOV6900 (RsrII/CIP) and pNOV6901-OsMADS13P/OsMADS13T (RsrII), were resolved on 1.0% TAE agarose and the 9.2 kb pNOV6900 (RsrII/CIP) and the 5.3 kb pNOV6901-OsMADS13P/OsMADS13T (RsrII) bands were excised, recovered and ethanol precipitated with glycogen carrier. The pNOV6900 (RsrII/CIP) and pNOV6901-OsMADS13P/OsMADS13T (RsrII) DNA fragments were recovered by micro centrifugation, washed with 70% ethanol, dried under vacuum and resuspended each in 5 µL ddH$_2$O.

4.0 µL of pNOV6900 (RsrII/CIP) was ligated to 4.0 µL pNOV6901-OsMADS13P/OsMADS13T (RsrII) in a 10 µL ligation mixture containing 1 µL 10× T4 DNA ligase buffer and 1 µL T4 DNA ligase (400 U/µL). The ligation mixture was incubated more than 8 hours at 16° C. 5.0 µL of ligation mixture was transformed into 50 µL Top10 competent cells. The pNOV6900-pNOV6901-OsMADS13P/OsMADS13T recombinants were verified by digesting 7.5 µL pNOV6900-pNOV6901-OsMADS13P/OsMADS13T miniprep DNA with 1.0 µL NcoI in 10 µL reaction mixtures containing 1 µg BSA and 1 µL 10× restriction endonuclease buffer. The digests were incubated at 37° C. for 2 hours then resolved on 1% TAE agarose. Positive pNOV6900-pNOV6901-OsMADS13P/OsMADS13T recombinants were sequenced. The finished clone was designated pNOV6905, which is also the plasmid's QC number.

The engineered alterations in the 5'-gene regulatory sequence derived from the OsMADS13 gene include introduction of an RsrII site at the 5'-end of OsMADS13P, insertion of a Kozak sequence upstream of the natural OsMADS13P translation start codon and modification of the natural OsMADS13P translation start codon so that it is contained within an NcoI site. The engineered alterations in the 3'-gene regulatory sequence derived from the OsMADS13 gene include introduction of a NotI site at the 5'-terminus of OsMADS13T and introduction of an RsrII site at the 3'-terminus of OsMADS13T. In this configuration the GUS coding sequence can be replaced with any gene of interest flanked by NcoI/NotI restriction sites. The complete cassette is mobilized, as an RsrII fragment, to the binary vector pNOV6900.

The cassette was transformed into A188 X HyII maize and Kaybonnet rice using standard *agrobacterium* mediated methodology.

GUS Expression in T0 Maize

Sixty-seven T0 transgenic maize lines were generated. Tassel spikelets were histochemically screened for GUS expression. Fifty-six were positive for GUS activity. Thirty-five also showed GUS expression in leaf punches. Ten lines had no detectable GUS activity in tassels or leaf punches.

Two T0 lines were selected to analyze GUS expression in developing ears. Both lines had a GUS signal in tassel spikelets and no GUS signal in leaf punches. Ears were harvested approximately 7 days before silking and histochemically stained for GUS expression. Whole sections showed a strong GUS signal only in developing florets, whereas GUS activity is absent in surrounding ear tissue. These data indicate the OsMADS13 expression cassette functions to drive GUS expression in both male and female spikelets in T0 maize transformants.

GUS Expression in T0 Rice

Thirty-three T0 rice lines were produced. Fourteen independent transformants were histochemically stained for GUS expression GUS activity was primarily detected in spikelets. Some plants also had GUS activity in leaf tissue.

intron and the 5'-UTR, the 3'-UTR and the 3'-nontranscribed sequence. These components were assembled into a GUS expression cassette and tested in transgenic plants. The cassette's design facilitates replacement of the GUS coding sequence with any gene of interest. The cassette will target gene expression to the vasculature within the placental tissue below the floret of developing ear spikelets. Post-fertilization, expression is also expected in the aleurone, hilar region and pedicel. Developmentally, the cassette should drive gene expression from a very early point, more than 7 days before pollination, in ovule development.

TABLE 3

Histochemical staining in Select T1 plant tissue

| Promoter | OsMADS5-GUS | OsMADS6-GUS | OsMADS8-GUS | OsMADS13-GUS | ZmM8-GUS |
|---|---|---|---|---|---|
| Leaf | negative | negative | negative | negative | negative |
| Stalk | negative | strong signal at ear branch | negative | slight signal at ear branch | negative |
| Root | negative | negative | negative | negative | negative |
| Seedling | negative | negative | negative | negative | negative |
| Tassel | negative | negative | negative | negative | negative |
| Silk | negative | negative | negative | negative | negative |
| Embryo & Endosperm | negative | negative | negative | negative | negative |
| Ear | modest in floret and some ear vasculature | strong in floret and some ear vasculature | strong in florets and central ear | strong in florets and some vasculature | modest in glume vasculature |

GUS Expression in T1 Maize

T1 progeny from three independent transformants were sown and analyzed in detail for GUS expression. There was no detectable GUS expression in leaf tissue, developing silk or tassels. This indicates tassel expression observed in T0 plants may result from tissue culture associated with the transformation process. Dissected organs from T1 tassels indicated no apparent GUS expression (data not shown). GUS activity is seen in the developing ear harvested about 5 days before pollination. The longitudinal section showed expression localized to developing ovules and transmitting or placental tissue. The cross section supports this and provides further evidence for expression in ear vasculature. GUS expression is observed in a second transgenic event. It also localizes to zones where ovules will likely develop. Expression localizes to vasculature supplying the developing ear.

These data support the OsMADS13 cassette as a very good candidate for trait expression in developing ovules. When driven by the OsMADS13-based expression cassette, genes that facilitate phloem unloading such as invertase or a sucrose transporter should prove effective in supporting early ear development by increasing sink strength.

The cassette continues to function post-fertilization. The observed GUS expression pattern at 4 and 6 days after pollination. Late in kernel development (21 days after pollination) GUS expression remains localized to the pedicel and hilar regions. It also appears in the aleurone. GUS protein is detectable throughout ovule and kernel development, up to 21 days after pollination. There is very light staining in the aerial tissue, with no GUS activity in the roots.

The present invention includes an expression cassette based on the *Oryza sativa* OsMADS13 gene. The expression cassette includes the gene's promoter, including the first

EXAMPLE 7

Identification of the OsT6PP cDNA Sequence

Figure 10:
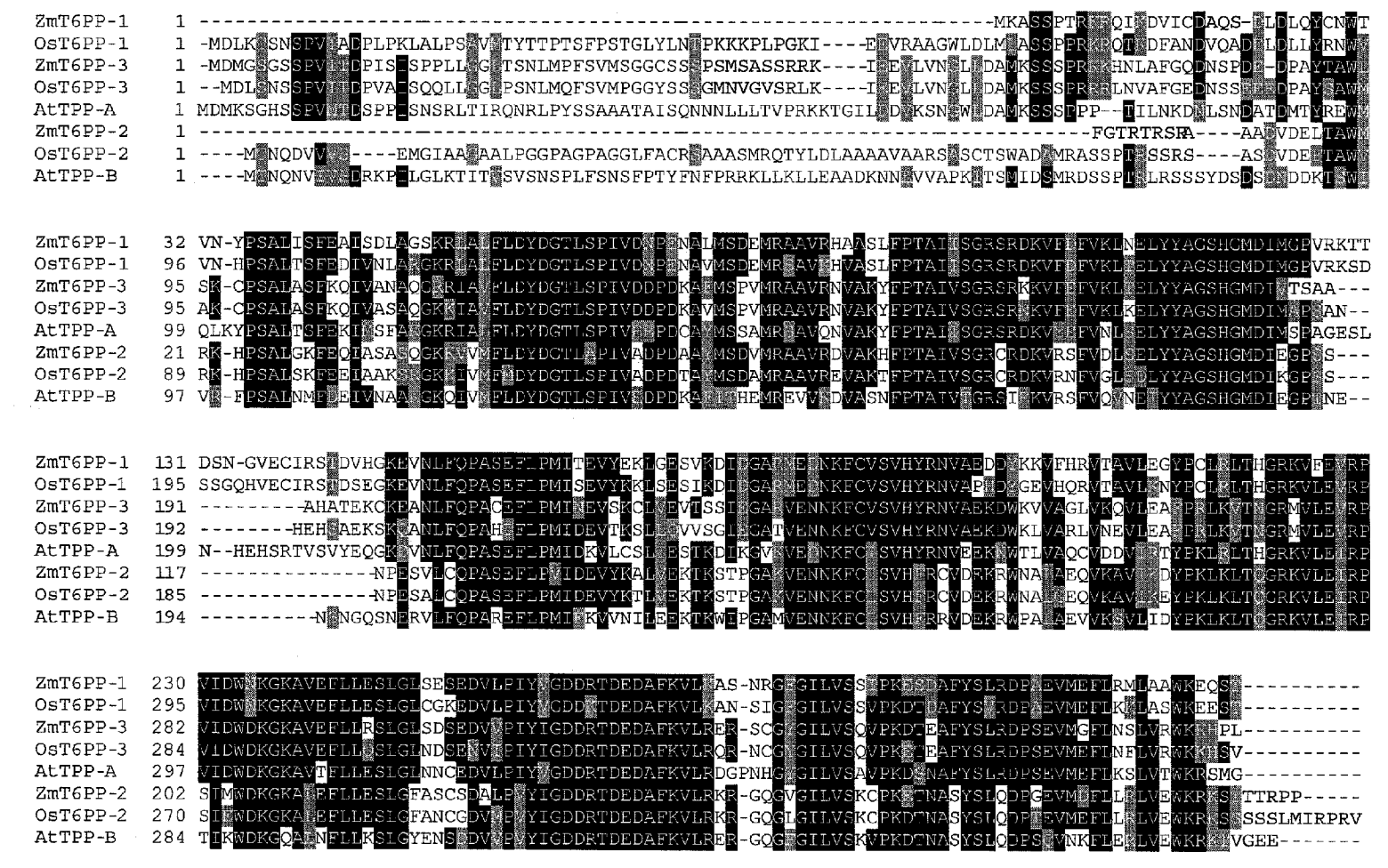

The first vascular plant trehalose-6-phosphate phosphatase genes were cloned from *Arabidopsis thaliana* by complementation of a yeast tps2 deletion mutant (Vogel et al. 1998). The genes designated AtTPPA and AtTPPB (GenBank accessions AF007778 and AF007779) were shown at that time to have trehalose-6-phosphate phosphatase activity. The AtTPPA and AtTTPB protein sequences were used in TBLASTN queries of maize and rice sequence databases. Sequence alignments organized the hits into individual genes. Three maize and three rice T6PP homologs were identified. The cDNA sequences corresponding to the predicted protein sequence for each gene—ZmT6PP-1, -2 and -3 and OsT6PP-1, -2 and -3—are shown in global alignment with the *Arabidopsis* T6PPs in FIG. 10.

The composition and method of the present invention includes using the OsMADS6 promoter operably linked to a nucleic acid molecule that when expressed in a plant cell, increases the expression of T6PP. By doing so, flux through the trehalose pathway is increased only in young developing ears where it functions to increase flux through central carbon metabolism.

The OsT6PP-3 cDNA sequence (SEQ ID NO. 531) is amplified using high-fidelity PCR. The 50 µL reaction mixture consists of 1 µL rice cDNA library (prepared from callus mRNA in Stratagene's Lambda Unizap Vector, primary library size>$1\times10^6$ pfu, amplified library titer>$1\times10^{12}$ pfu/mL), 200 µM dNTPs, 1 µL 20 µM of oligonucleotide primer T6PP-EC-5 (5'-catggaccatggatttgagcaatagctcac-3') SEQ ID NO. 528 and 1 µL 20 µM of oligonucleotide primer T6PP-EC-3 (5'-atcgcagagctcacactgagtgcttcttcc-3') SEQ ID NO.

529, 5 µL 10× Cloned PFU buffer and 2.5 Units of Pfuturbo DNA polymerase. The thermocycling program is 95° C. for 2 minutes followed by 40 cycles of (94° C. for 15 seconds, 50° C. for 1 minute, 72° C. for 1 minute) followed by 72° C. for 10 minutes. The OsT6PP-3 product is cloned with the Zero Blunt TOPO PCR cloning kit. The pCR-Blunt-II-TOPO-OsT6PP-3 is identified by digesting 5 µL pCR-Blunt-II-TOPO-OsT6PP-3 miniprep DNA with EcoRI in a 20 µL reaction containing 2 µg BSA and 2 µL 10× EcoRI restriction endonuclease buffer. The reaction is incubated at 37° C. for 2 hours and the pCR-Blunt-II-TOPO-OsT6PP-3 (EcoRI) products are resolved on 1% TAE agarose. The pCR-Blunt-II-TOPO-OsT6PP-3 clone is then sequenced. The OsT6PP-3 cDNA is flanked by NcoI/SacI restriction endonuclease sites.

To facilitate cloning into 11082, an internal NcoI site in OsT6PP was silenced using Stratagene's QuikChange Multi Site-Directed Mutagenesis Kit and the oligonucleotide primer T6PP-QC (5'-CTTTATTATGCTGGAAGTCATGG-TATGGACATAATGGCACC-3') SEQ ID NO. 530.

EXAMPLE 8

Construction of OsMADS6-T6PP

A. Construction of the OsMADS6-OsT6PP-3 Expression Cassette

The pCR-Blunt-II-TOPO-OsT6PP-3 clone (14 µL) DNA was digested in a 20 µL reaction mixture containing 2 µg BSA, 2 µL 10× restriction endonuclease buffer, 1 µL NcoI and 1 µL SacI. The digest was incubated at 37° C. for more than 6 hours. The pCR-Blunt-II-TOPO-OsT6PP-3 (NcoI/SacI) DNA was resolved on 1.0% TAE agarose and the 1.3 kb OsT6PP-3 (NcoI/SacI) band was excised, recovered and ethanol precipitated with glycogen carrier. The OsT6PP-3 (NcoI/SacI) DNA was recovered by micro centrifugation, washed with 70% ethanol, dried under vacuum and resuspended in 5 µL ddH$_2$O.

2 µg 11082 miniprep DNA was digested in a 20 µL reaction mixture containing 2 µg BSA, 2 µL 10× restriction endonuclease buffer, 1 µL NcoI and 1 µL SacI. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. The 11082 (NcoI/SacI/CIP) DNA was resolved on 1.0% TAE agarose and the 8.1 kb 11082 (NcoI/SacI/CIP) band was excised, recovered and ethanol precipitated with glycogen carrier. The 11082 (NcoI/SacI/CIP) DNA fragment was recovered by micro centrifugation, washed with 70% ethanol, dried under vacuum and resuspended in 5 µL ddH$_2$O.

Figure 11A:
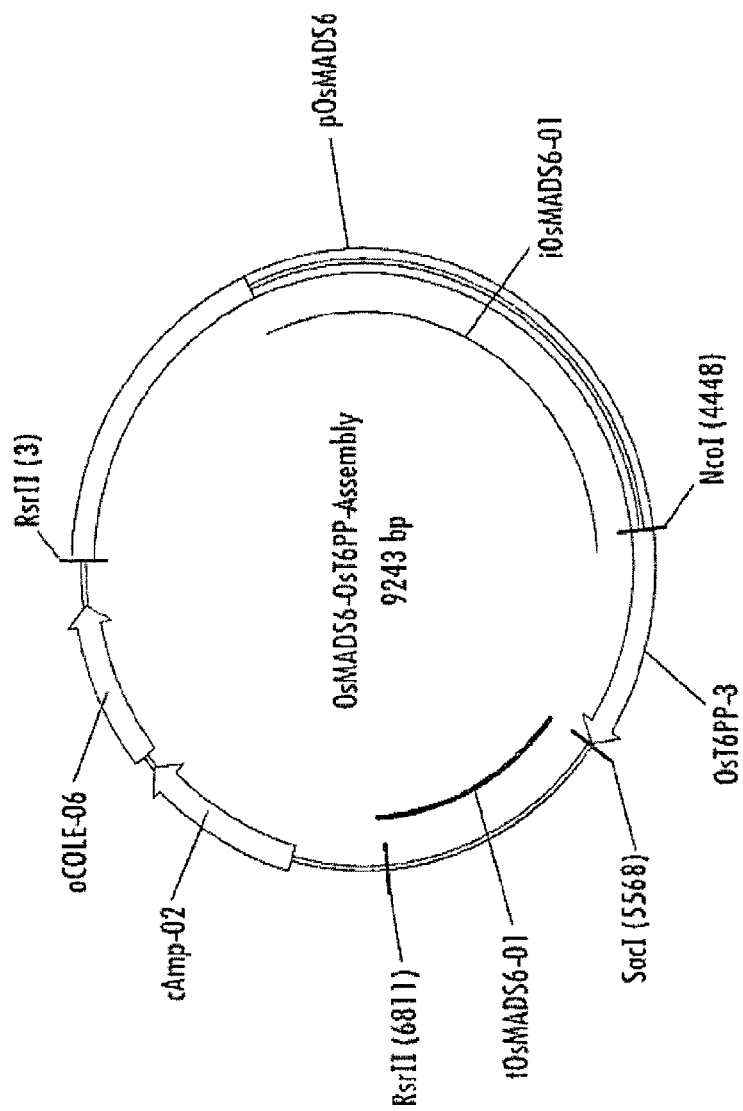
FIG. 11A shows the OsMADS6-OsT6PP-Assembly vector.

4.0. mu.L 11082 (NcoI/SacI/CIP) was ligated to 4.0. mu.L OsT6PP-3 (NcoI/SacI) in a 10 .mu.L reaction mixture containing 1. mu.L 10.times. T4 DNA ligase buffer and 1. mu.L T4 DNA ligase (400 Units/.mu.L). The reaction mixture was incubated more than 8 hours at 16.degree. C. 5.0. mu.L of ligation mixture was transformed into 50. mu.L Top10 competent cells. The recombinants were verified by digesting 7.5. mu.L 11082-OsT6PP-3 miniprep DNA with 1.0 .mu.L RsrII in 10. mu.L reaction mixtures containing 1. mu.g BSA and 1. mu.L 10.times. restriction endonuclease buffer. The digests were incubated at 37. degree. C. for 2 hours then resolved on 1% TAE agarose. Positive 11082-OsT6PP-3 recombinants were sequenced. The vector was designated OsMADS6-OsT6PP-Assembly and is shown in FIG. 11A.

B. Mobilization of the OsMADS6-OsT6PP-Assembly Expression Cassette into pNOV6900

2 µg pNOV6900 was digested in a 20 µL reaction mixture containing 2 µg BSA, 2 µL 10× restriction endonuclease buffer and 2 µL RsrII. The digest was incubated at 37° C. for more than 6 hours, then at 70° C. for 20 minutes. Then 1 µL of the appropriate 10× restriction endonuclease buffer, 1 µL 1 Unit/µL CIP and 8 µL ddH$_2$O were added to the reaction and it was further incubated at 37° C. for 30 minutes. 2 µg pNOV6906-OsT6PP-Assembly miniprep DNA was digested in a 20 µL reaction mixture containing 2 µg BSA, 2 µL 10× restriction endonuclease buffer and 2 µL RsrII. The digest was incubated at 37° C. for more than 6 hours.

The pNOV6900 (RsrII/CIP) and the pNOV6906-OsT6PP-Assembly (RsrII) plasmid DNAs were resolved on 1.0% TAE agarose, and the 9.2 kb pNOV6900 (RsrII/CIP) and the 6.8 kb pNOV6906-OsT6PP-Assembly (RsrII) bands were excised, recovered and ethanol precipitated with glycogen carrier. The pNOV6900 (RsrII/CIP) and pNOV6906-OsT6PP-Assembly (RsrII) DNA fragments were recovered by micro centrifugation, washed with 70% ethanol, dried under vacuum and resuspended in 5 µL ddH$_2$O each.

Figure 11B:
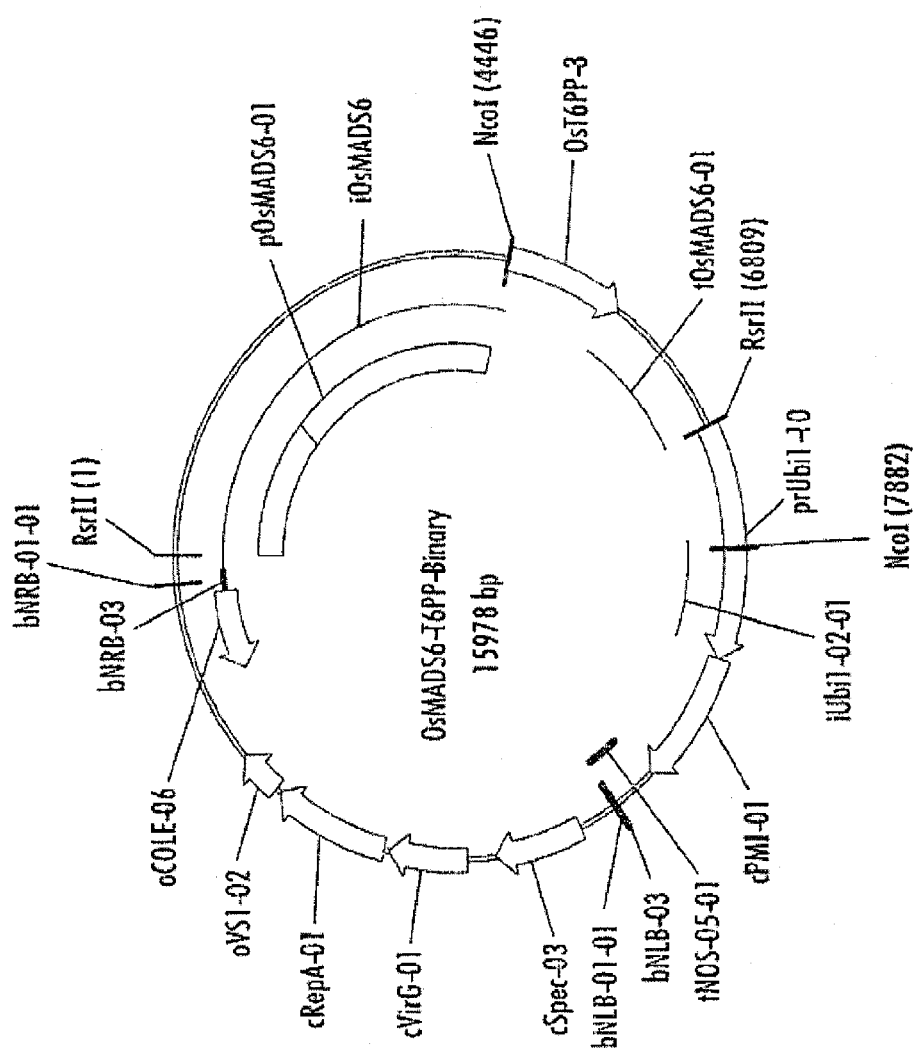
FIG. 11B shows the OsMADS6-OsT6PP-Binary vector.

4.0. mu.L pNOV6900 (RsrII/CIP) was ligated to 4.0. mu.L pNOV6906-OsT6PP-Assembly (RsrII) in a 10. mu.L ligation mixture containing 1. mu.L 10.times. T4 DNA ligase buffer and 1. mu.L T4 DNA ligase (400 U/.mu.L). The ligation mixture was incubated more than 8 hours at 16. degree. C. 5.0. mu.L of ligation mixture was transformed into 50. mu.L Top10 competent cells. The pNOV6900-pNOV6906-OsT6PP-Assembly recombinants were verified by digesting 7.5. mu.L miniprep DNA with 1.0. mu.L NcoI in 10. mu.L reaction mixtures containing 1. mu.g BSA and 1. mu.L 10.times. restriction endonuclease buffer. The digests were incubated at 37. degree. C. for 2 hours then resolved on 1% TAE agarose. Positive pNOV6900-pNOV6906-OsT6PP-Assembly recombinants were sequenced. The finished clone was designated OsMADS6-OsT6PP-Binary and is shown in FIG. 11B. The plasmid's QC number is 12194.

The OsMADS6-OsT6PP-3 expression cassette (SEQ ID NO. 533) was transformed into A188 maize using standard *agrobacterium* mediated methodology. Regenerated T0 shoots were screened transgene copy number and insert integrity using a Taqman™ assay. Events containing a single copy of the OsMADS6-OsT6PP-3 expression cassette and no other sequence derived from the binary vector were identified.

Expression cassette function in each transgenic Event was verified by RT-PCR. DNA-free total RNA template was prepared from 100 mg of T0 tassel tissue using the RNeasy Plant mini Kit. The RT-PCR assay was performed using the Qiagen One Step RT-PCR kit with 100 ng total RNA template, the T6PP-RTPCRF (5'-gacagaactgacgaagacgctttcaa-3') and 6906-tr (5'-ctccaacttctgacagctg-3') primers (SEQ ID NOS. 534, 535 respectively). This assay produces a transgene-specific 210 bp fragment.

EXAMPLE 9

Greenhouse Growth Conditions

Corn seed is sown into 2.5 SVD pots (Classic 600, ~2 gallon nursery containers) in Universal mix (Sungrow Horticulture, Pine Bluff, Ark.). Universal mix is 45% Peat moss, 45% bark, 5% perlite, 5% vermiculite. Environmental conditions for greenhouse maize cultivation are typically 16 hour days (average light intensity 600 µmol m$^{-2}$s$^{-2}$), day time temperature of 80-86° F., night time temperature 70-76° F. and relative humidity greater than 50%. Plants are placed on 2" platforms to avoid contact with the greenhouse floor. Plants are hand watered until daily irrigation as required, then they are placed on irrigation drip. The irrigation schedule is 4 minutes every other day. Plants were routinely treated with insecticides to control pests.

EXAMPLE 10

Evaluation of Transgenic Maize Expressing OsMADS6-OsT6PP-3 in the Greenhouse The greenhouse evaluation is a controlled water-stress experiment that quantifies ovule viability in water-stressed and unstressed plants. Data from unstressed plants represent the genotype's potential to set seed under ideal conditions. Data from water-stressed plants quantify kernel abortion that results from drought at the time of flowering. The results of these experiments can be predictive of field performance. We used this tool to select transgenic events for field evaluations.

Transgenic maize segregating for a single copy of the OsMADS6-T6PP-3 transgene were sown as above. Taqman analysis was used to divide the progeny into homozygous or hemizygous (containing OsMADS6-OsT6PP-3) and azygous (lost the OsMADS6-OsT6PP-3) groups. These individuals were pollinated with JHAF031 maize pollen to generate hybrid seed (KPOO188RA×JHAF031) for the greenhouse experiment. The hybrid seed were sown as above. Seedlings were transferred to 600 pots, above, and maintained using standard greenhouse procedures until they reached the V6 growth stage (Ritchie et al., 1997). All plants were treated with the systemic pesticide, Marathon, to reduce susceptibility to pests. Water stress was gradually imposed, using salt as the osmoticum (Nuccio et al. 1998). The salt consisted of sodium chloride/calcium chloride at a 10:1 molar ratio, delivered in 0.5× Hoagland's Solution, to prevent sodium-induced disruption of potassium uptake. Salt concentration in the irrigant was increased from 50 mM to 100 mM to 150 mM every three days to give plants time to adjust to the salt. Plants were maintained on 150 mM salt solution through the flowering period, typically two weeks, after which pots were thoroughly flushed with water and plants were returned to normal irrigation. This protocol typically reduced kernel set by 40-60%, compared to control plants that received no salt.

Typically 15-20 seed per transgenic event were sown to generate a uniform seedling population. Plants were arranged in a complete, randomized block design consisting of six-eight replicates per treatment. Developing ears were covered with pollination bags before silk emergence. Pollen shed and silk emergence dates were recorded and individual ears were hand pollinated with donor pollen 5 days after silk emergence. Pollination bags were removed after completing all pollinations. Ears were harvested 30 days after pollinations, and dried for 4 days to 15% moisture content. Ears were shelled and the kernels were counted and weighed.

EXAMPLE 11

Greenhouse Experiment

Two OsMADS6-T6PP-3 events were studied for their ability to set seed under water stress. Twenty-four hybrid seed (A188×JHAF031) from each event were germinated. Taqman analysis was used to establish zygosity in each seedling. Hemizygotes and azygotes were analyzed using the greenhouse water stress protocol described above. In this experiment azygote plants served as the benchmark. In these greenhouse experiments, the hemizygote plants could not be distinguished from the azygote plants. On average the water stress reduced kernel set by 42%. The data in these greenhouse experiments indicate the OsMADS6-T6PP-3 expression cassette does not influence kernel set in maize in these particular greenhouse experiments and when evaluated by the above water stress protocols.

EXAMPLE 12

Evaluation of Transgenic Maize Expressing OsMADS-T6PP-3 for Drought Stress Tolerance in the Field Hybrid seed were generated for each transgenic Event at the Syngenta Seeds field station in Kauai in late 2004. T1 seed obtained by selfing the T0 plant of the events was sown in four single-row plots, 12.7 feet long separated by 3 foot alleys with about 20 plants per row. Taqman analysis was used to divide the progeny into homozygous or hemizygous (containing OsMADS6-OsT6PP-3) and azygous (lost the OsMADS6-OsT6PP-3) groups. In two of the single-row plots, hemizygous and azygous plants were destroyed and homozygous plants were selfed for seed bulking and also testcrossed to NP2043BT11 and NP2044BT11. In the other two single-row plots homozygous and hemizygous plants were destroyed and azygous plants were selfed and also crossed to NP2043BT11 and NP2044BT11. The azygous and hemizygous testcross seed of the events was used to conduct field trials.

A field evaluation was conducted to test transgene performance in a controlled drought experiment. The experiment was conducted at the Syngenta Crop Protection Facility in Visalia, Calif. in the summer of 2004. The planting site typically gets less than 3" of rainfall during the summer. The NP2043BT11 testcross seed, generated above, was used in this study. This population also contained the BT transgene to control insect pressure. A split-block design, with watering regime as the main plots arranged in a randomised complete blocks and replicated three times, events as the subplots, and in cases where there was seed of the azgous and hemizygous hybrids, genotype as sub-sub-plots was used. Two watering regimes were attempted: water-stressed and well-watered. Each plot consisted of two-rows, 17.5 feet long planted with 40 seeds per row. Alleys between ranges were 2.5 feet. Furrow irrigation was used to water the fields. Each treatment block had a dedicated irrigation source situated at one end of the field. The replication were arranged in such a way that replication one was closest to and replication three was the furthest from the irrigation source. After emergence, stand counts were taken and plots were thinned, as necessary, to establish field uniformity.

The well-watered block was thought to have been irrigated optimally throughout the experiment. The water-stress block was watered optimally until plants reached approximately V, at which time water was withheld. Plants were returned to optimal irrigation after 90% silk emergence.

After plants transitioned to reproductive development, the 50% pollen shed date, the 50% silk emergence date, and leaf scrolling at early-, mid- and late-flowering were recorded for each plot. Plot Barreness was recorded three weeks after silking.

Figure 12:
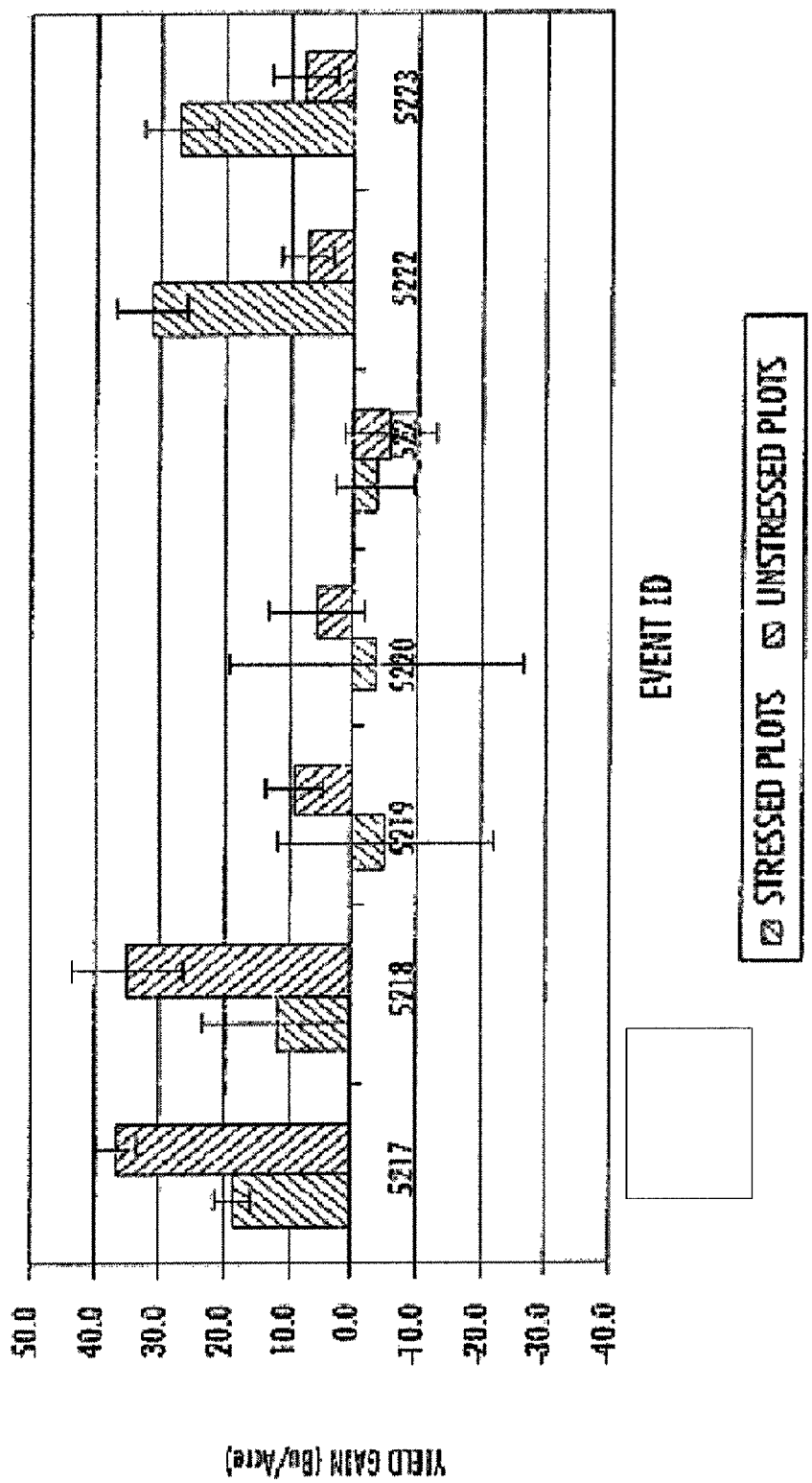
FIG. 12 shows the effect of the OsMADS6-T6PP-3 transgene on yield in a drought stress study.

Plots were combine-harvested and grain yield and grain moisture were recorded. The data from hemizygous plots were compared to azygous plots, or wild type plots where necessary, to gauge the transgene's effect on yield. Results for seven OsMADS6-T6PP-3 events are shown in FIG. 12. The data show the OsMADS6-T6PP-3 transgene has a positive effect on yield in four of the seven Events. The yield gain is evident in both unstressed and drought-stressed plots. For example in the drought-stressed treatment block the average yield for 5217 Events containing the transgene was 73 Bu/acre and the average yield for 5217 Events lacking the transgene was 54 Bu/acre. Results suggest the transgene improves kernel set by 25% in drought-stressed conditions. In the less stressed treatment block the average yield for 5217 Events containing the transgene was 132 Bu/acre and the average yield for 5217 Events lacking the transgene was 95 Bu/acre. Results suggest the transgene improves kernel set by nearly 28% in less stressed plants. The average yield calculated for each plot in the drought-stressed treatment block was 72 Bulacre. The average yield calculated for each plot in the less stressed treatment block was 113 Bu/acre. The yield improvement due to the OsMADS6-T6PP-3 gene varies from Event to Event. It is observed in four of the seven Events tested, and is manifest in both less stressed and drought-stressed plants. Results from this field experiment demonstrate the effectiveness of the OsMADS-T6PP-3 transgene in stabilizing kernel set in drought stressed maize.

EXAMPLE 13

Evaluation of Transgenic Maize Expressing OsMADS-T6PP-3 for Yield in the Field

Hybrid seed was generated for each transgenic Event at the Syngenta Seeds field station in Kauai in late 2004. T1 seed obtained by selfing the T0 plant of the events was sown in four single-row plots, 12.7 feet long separated by 3 foot alleys with about 20 plants per row. Taqman analysis was used to divide the progeny into homozygous or hemizygous (containing OsMADS6-OsT6PP-3) and azygous (lost the OsMADS6-OsT6PP-3) groups. In two of the single-row plots, hemizygous and azygous plants were destroyed and homozygous plants were selfed for seed bulking also testcrossed to NP2043BT11 and NP2044BT11. In the other two single-row plots homozygous and hemizygous plants were destroyed and azygous plants were selfed and also crossed to NP2043BT11 and NP2044BT11. The azygous and hemizygous testcross seed of the events was used to conduct field trials. A series of yield trials were conducted in several mid-West locations to test transgene performance under conditions typically used by growers. The XPOO188RA× NP2043BT11 material, generated above, was used in late maturity zones and the XPOO188RA×JHAF431B material, generated above, was used in early maturity zones. These populations also contained the BT transgene to control insect pressure. The experimental design consisted of randomised complete blocks with three replications. Each experimental unit consisted of two-row plots, 17.5 feet long planted with 34 kernels per row. Ranges were separated by 3 foot alleys. Events for which there was seed of both the azygous and the hemizygous hybrids, randomization was restricted to keep the azygous and hemizygous hybrids of the events in neighboring plots. Most Events were evaluated in eight to nine locations. Event 5124 was evaluated in three locations. After emergence, stand counts were taken and plots were thinned, as necessary, to establish field uniformity. During the growing season plots were evaluated for intactness, greensnap, root lodging, heat units to 50% pollen shed and heat units to 50% silking.

Plots were Combine-harvested and grain yield and grain moisture were recorded. The data from hemizygous plots were compared to azygous plots, or wild type plots where necessary, to gauge the transgene's effect on yield. The data shows that the OsMADS-T6PP-3 transgene does not significantly affect yield in this experiment. There are two factors to consider. First the standard deviation for grain yield in this experiment was 15-20% of the mean. This is not unusual. Second, growth conditions in the mid-West were ideal for maize in 2004. Depending on location yields in this experiment averaged from 90 to 130 Bu/acre. Results from this field experiment indicate the OsMADS-T6PP-3 transgene did not cause yield drag.

EXAMPLE 14

Transformation

Once a nucleic acid sequence of the invention has been cloned into an expression system, it is transformed into a plant cell. The receptor and target expression cassettes of the present invention can be introduced into the plant cell in a number of art-recognized ways. Methods for regeneration of plants are also well known in the art. For example, Ti plasmid vectors have been utilized for the delivery of foreign DNA, as well as direct DNA uptake via electroporation, microinjection, and microprojectiles. In addition, bacteria from the genus *Agrobacterium* can be utilized to transform plant cells. Below are descriptions of representative techniques for transforming both dicotyledonous and monocotyledonous plants, as well as a representative plastid transformation technique.

A. Transformation of Dicotyledons

Transformation techniques for dicotyledons are well known in the art and include *Agrobacterium*-based techniques and techniques that do not require *Agrobacterium*. Non-*Agrobacterium* techniques involve the uptake of exogenous genetic material directly by protoplasts or cells. This can be accomplished by PEG or electroporation mediated uptake, particle bombardment-mediated delivery, or microinjection. Examples of these techniques are described by Paszkowski et al., EMBO J. 3: 2717-2722 (1984), Potrykus et al., Mol. Gen. Genet. 199: 169-177 (1985), Reich et al., Biotechnology 4: 1001-1004 (1986), and Klein et al., Nature 327: 70-73 (1987). In each case the transformed cells are regenerated to whole plants using standard techniques known in the art.

*Agrobacterium*-mediated transformation is a preferred technique for transformation of dicotyledons because of its high efficiency of transformation and its broad utility with many different species. *Agrobacterium* transformation typically involves the transfer of the binary vector carrying the foreign DNA of interest (e.g. pCIB200 or pCIB2001) to an appropriate *Agrobacterium* strain which may depend on the complement of vir genes carried by the host *Agrobacterium* strain either on a co-resident Ti plasmid or chromosomally (e.g. strain CIB542 for pCIB200 and pCIB2001 (Uknes et al. Plant Cell 5: 159-169 (1993)). The transfer of the recombinant binary vector to *Agrobacterium* is accomplished by a triparental mating procedure using *E. coli* carrying the recombinant binary vector, a helper *E. coli* strain which carries a plasmid such as pRK2013 and which is able to mobilize the recombinant binary vector to the target *Agrobacterium* strain. Alternatively, the recombinant binary vector can be transferred to *Agrobacterium* by DNA transformation (Höfgen & Willmitzer, Nucl. Acids Res. 16: 9877 (1988)).

Transformation of the target plant species by recombinant *Agrobacterium* usually involves co-cultivation of the *Agrobacterium* with explants from the plant and follows protocols well known in the art. Transformed tissue is regenerated on selectable medium carrying the antibiotic or herbicide resistance marker present between the binary plasmid T-DNA borders.

Another approach to transforming plant cells with a gene involves propelling inert or biologically active particles at plant tissues and cells. This technique is disclosed in U.S. Pat. Nos. 4,945,050, 5,036,006, and 5,100,792 all to Sanford et al. Generally, this procedure involves propelling inert or biologically active particles at the cells under conditions effective to penetrate the outer surface of the cell and afford incorporation within the interior thereof. When inert particles are utilized, the vector can be introduced into the cell by coating the particles with the vector containing the desired gene. Alternatively, the target cell can be surrounded by the vector so that the vector is carried into the cell by the wake of the particle. Biologically active particles (e.g., dried yeast cells, dried bacterium or a bacteriophage, each containing DNA sought to be introduced) can also be propelled into plant cell tissue.

B. Transformation of Monocotyledons

Transformation of most monocotyledon species has now also become routine. Preferred techniques include direct gene transfer into protoplasts using PEG or electroporation techniques, and particle bombardment into callus tissue. Transformations can be undertaken with a single DNA species or multiple DNA species (i.e. co-transformation) and both these techniques are suitable for use with this invention. Co-transformation may have the advantage of avoiding complete vector construction and of generating transgenic plants with unlinked loci for the gene of interest and the selectable marker, enabling the removal of the selectable marker in subsequent generations, should this be regarded desirable. However, a disadvantage of the use of co-transformation is the less than 100% frequency with which separate DNA species are integrated into the genome (Schocher et al. Biotechnology 4: 1093-1096 (1986)).

Patent Applications EP 0 292 435, EP 0 392 225, and WO 93/07278 describe techniques for the preparation of callus and protoplasts from an elite inbred line of maize, transformation of protoplasts using PEG or electroporation, and the regeneration of maize plants from transformed protoplasts. Gordon-Kamm et al. (Plant Cell 2: 603-618 (1990)) and Fromm et al. (Biotechnology 8: 833-839 (1990)) have published techniques for transformation of A188-derived maize line using particle bombardment. Furthermore, WO 93/07278 and Koziel et al. (Biotechnology 11: 194-200 (1993)) describe techniques for the transformation of elite inbred lines of maize by particle bombardment. This technique utilizes immature maize embryos of 1.5-2.5 mm length excised from a maize ear 14-15 days after pollination and a PDS-1000He Biolistics device for bombardment.

Transformation of rice can also be undertaken by direct gene transfer techniques utilizing protoplasts or particle bombardment. Protoplast-mediated transformation has been described for *Japonica*-types and *Indica*-types (Zhang et al. Plant Cell Rep 7: 379-384 (1988); Shimamoto et al. Nature 338: 274-277 (1989); Datta et al. Biotechnology 8: 736-740 (1990)). Both types are also routinely transformable using particle bombardment (Christou et al. Biotechnology 9: 957-962 (1991)). Furthermore, WO 93/21335 describes techniques for the transformation of rice via electroporation.

Patent Application EP 0 332 581 describes techniques for the generation, transformation and regeneration of Pooideae protoplasts. These techniques allow the transformation of *Dactylis* and wheat. Furthermore, wheat transformation has been described by Vasil et al. (Biotechnology 10: 667-674 (1992)) using particle bombardment into cells of type C long-term regenerable callus, and also by Vasil et al. (Biotechnology 11: 1553-1558 (1993)) and Weeks et al. (Plant Physiol. 102: 1077-1084 (1993)) using particle bombardment of immature embryos and immature embryo-derived callus. A preferred technique for wheat transformation, however, involves the transformation of wheat by particle bombardment of immature embryos and includes either a high sucrose or a high maltose step prior to gene delivery. Prior to bombardment, any number of embryos (0.75-1 mm in length) are plated onto MS medium with 3% sucrose (Murashiga & Skoog, Physiologia Plantarum 15: 473-497 (1962)) and 3 mg/l 2,4-D for induction of somatic embryos, which is allowed to proceed in the dark. On the chosen day of bombardment, embryos are removed from the induction medium and placed onto the osmoticum (i.e. induction medium with sucrose or maltose added at the desired concentration, typically 15%). The embryos are allowed to plasmolyze for 2-3 hours and are then bombarded. Twenty embryos per target plate is typical, although not critical. An appropriate gene-carrying plasmid (such as pCIB3064 or pSG35) is precipitated onto micrometer size gold particles using standard procedures. Each plate of embryos is shot with the DuPont Biolistics® helium device using a burst pressure of ~1000 psi using a standard 80 mesh screen. After bombardment, the embryos are placed back into the dark to recover for about 24 hours (still on osmoticum). After 24 hrs, the embryos are removed from the osmoticum and placed back onto induction medium where they stay for about a month before regeneration. Approximately one month later the embryo explants with developing embryogenic callus are transferred to regeneration medium (MS+1 mg/liter NAA, 5 mg/liter GA), further containing the appropriate selection agent (10 mg/l basta in the case of pCIB3064 and 2 mg/l methotrexate in the case of pSOG35). After approximately one month, developed shoots are transferred to larger sterile containers known as "GA7s" which contain half-strength MS, 2% sucrose, and the same concentration of selection agent.

Transformation of monocotyledons using *Agrobacterium* has also been described. See, WO 94/00977 and U.S. Pat. No. 5,591,616, both of which are incorporated herein by reference. See also, Negrotto et al., *Plant Cell Reports* 19: 798-803 (2000), incorporated herein by reference.

EXAMPLE 15

Use of Expression Cassettes of the Present Invention to Confer Abiotic Stress Tolerance in Plants Once initiated, maize female spikelets are by definition metabolic sinks. They require a nutrient stream consisting of carbohydrate, amino acids, cofactors, minerals and other material from source tissues to fuel development. Source tissues include leaves, roots, the stalk and other vegetative plant parts. Much of what arrives at each spikelet is rapidly consumed, being converted to cell wall material, protein, lipids, nucleic acids etc. Very little is held in reserve.

The nutrient stream subsides during periods of abiotic stress. This stress is imposed by a number of stimuli including drought, cloud cover, temperature extremes and soil nutrient depletion. Spikelet development continues despite growing conditions, relying on reserves for energy and raw material. Reserves maintain development for, at most, a few days. If the abiotic stress period is prolonged reserves are depleted and spikelet development ceases. The result is kernel abortion and reduced yield.

The OsMADS expression cassettes of the present invention can be used to increase the sink strength in female spikelets by fusing them to genes that function to increase sink strength. These genes include a sucrose transporter, invertase, and trehalose metabolism genes. Many of these genes are not highly expressed in early spikelet development. Early and specific expression in the reproductive organs of plants, spikelets for example, of any of these genes will improve spikelet nourishment without detriment to other plant organs. Improved nutrition will enable spikelets to complete their developmental cycle and become competent for fertilization during ideal growth conditions and, importantly, during prolonged periods of abiotic stress.

Carbon arrives at developing spikelets as sucrose. Spikelets have limited ability to utilize sucrose because enzymes facilitating its entry into metabolism are not highly expressed. These enzymes include sucrose transporter(s) to aid uptake of sucrose unloaded from the phloem. The OsMADS expression cassettes can increase sucrose transporter levels in the transmitting and other maternal tissue. Imported sucrose fuels development and excess sucrose is incorporated into starch and vacuolar reserves. Increased starch and sucrose reserves better enable spikelets to complete development during prolonged periods of abiotic stress.

Carbon nutrition can also be enhanced via increased invertase expression. This enzyme family cleaves sucrose into glucose and fructose. Both monosaccharides can be accumulated to high levels and rapidly enter carbon metabolism. The OSMADS expression cassettes of the present invention can be used to increase glucose and fructose levels in the apoplastic regions of spikelet and other maternal tissues via expression of an apoplastic or cell wall invertase. The monosaccharides enter cells and carbon metabolism more readily than sucrose. Facilitated sucrose utilization should increase sucrose unloading from the phloem, and carbon availability to developing spikelets.

Similarly, carbon nutrition in the cytosol of developing spikelets can be enhanced via expression of a cytosolic or neutral invertase. This enzyme cleaves sucrose in the cytosol, facilitating entry into carbon metabolism. The OSMADS expression cassettes of the present invention can increase neutral invertase expression in developing spikelets. The increased sucrose utilization in the cytosol, in transmitting and related spikelet tissue increases sucrose demand and thus, sucrose import from the apoplast.

Carbon availability and abiotic stress resistance in developing spikelets also can be enhanced via expression of a vacuolar or soluble acid invertase. This enzyme cleaves sucrose into fructose and glucose in the vacuole, making the carbon available for energy metabolism. Sucrose conversion into glucose and fructose also increases the solute potential of the cell, enabling it to maintain water and thus, turgor during periods of drought. This allows spikelets to continue developing despite decreased water availability. Again, the OSMADS expression cassettes of the present invention can increase expression of vacuolar or soluble acid invertase in developing spikelets for the purpose of enhancing abiotic stress tolerance.

The trehalose pathway functions to regulate carbon partitioning between primary metabolism and starch synthesis. Up-regulation of this pathway directs carbon towards starch synthesis. The OsMADS expression cassettes of the present invention can be used to drive expression of trehalose-6-phosphate synthase, trehalose-6-phosphate phosphatase and trehalase in developing spikelets, thereby increasing sink strength and starch synthesis in those tissues. Maintenance of a large starch pool better enables developing spikelets to withstand prolonged periods of abiotic stress and complete their development cycle.

Although the foregoing invention has been described in some detail by way of illustration and example for purposes of clarity of understanding, it will be obvious that certain changes and modifications may be practiced with the scope of the present invention.

REFERENCES

Iyer M., Wu L., et al. V (2001) Two step transcriptional amplification as a method for imaging reporter gene expression using weak promoters PNAS 98(25):14595-14600.

De Bodt, S., Raes, J., Van de Peer, Y., and Theien, G. (2003) And then there were many: MADS goes genomic. Trends Plant Sci. 8(10): 475-483.

Larkin, J. C., Oppenheimer, D. G., Pollock, S., and Marks, M. D. (1993) *Arabidopsis* GLABROUS1 gene requires downstream sequences for function. Plant Cell. 5(12): 1739-1748.

Kang, H.-G. and An, G. (1997) Isolation and characterization of a rice MADS box gene belonging to the AGL2 gene family. Mol. Cells. 7(1), 45-51.

Onodera, Y., Suzuki, A., Wu, C.-Y., Washida, H., and Takaiwa, F. (2001) A rice functional transcriptional activator, RISBZ1, responsible for endosperm-specific expression of storage protein genes through GCN4 motif. J. Biol. Chem. 276(17): 14139-14152.

Sieburth, L. E., and Meyerowitz, E. M. (1997) Molecular dissection of the AGAMOUS control region shows that cis elements for spatial regulation are located intragenically. Plant Cell. 9(3): 355-365.

Yu, H., and Goh, C. J. (2000) Identification and characterization of three orchid MADS-box genes of the AP1/AGL9 subfamily during floral transition. Plant Physiol. 123: 1325-1336.

De Bodt et al (2003) And then there were many: MADS goes genomic. Trends Plant Sci. 8(10): 475-483.

Larkin et al (1993) *Arabidopsis* GLABROUS1 gene requires downstream sequences for function. Plant Cell. 5(12): 1739-1748.

Kang, H.-G. and An, G. (1997) Isolation and characterization of a rice MADS box gene belonging to the AGL2 gene family. Mol. Cells. 7(1), 45-51.

Onodera et al (2001) A rice functional transcriptional activator, RISBZ1, responsible for endosperm-specific expression of storage protein genes through GCN4 motif. J. Biol. Chem. 276(17): 14139-14152.

Sieburth, L. E., and Meyerowitz, E. M. (1997) Molecular dissection of the AGAMOUS control region shows that cis elements for spatial regulation are located intragenically. Plant Cell. 9(3): 355-365.

Yu, H., and Goh, C. J. (2000) Identification and characterization of three orchid MADS-box genes of the AP1/AGL9 subfamily during floral transition. Plant Physiol. 123: 1325-1336.

Batzer, et al (1991) Enhanced evolutionary PCR using oligonucleotides with inosine at the 3'-terminus. Nucleic Acid Res. 19:5081.

Ohtsuka, et al (1985) An alternative approach to deoxyoligonucleotides as hybridization probes by insertion of deoxyinosine at ambiguous codon positions. J. Biol. Chem. 260: 2605-2608.

Rossolini, et al (1994) Use of deoxyinosine-containing primers vs degenerate primers for polymerase chain reaction based on ambiguous sequence information. Mol. Cell Probes 8:91-98.

Paszkowski et al (1984). Direct Gene Transfer to Plants. EMBO J. 3:2717-2722

Potrykus et al (1985) Molecular and general genetics of a hybrid foreign gene introduced into tobacco by direct gene transfer. Mol. Gen. Genet. 199:169-177

Reich et al (1986) Efficient transformation of alfalfa protoplasts by the intranuclear microinjection of Ti-plasmids. Bio/Technology 4:1001-1004

Klein et al (1987) High velocity microprojectiles for delivering nucleic acids into living cells. Nature 327:70-73.

Uknes et al (1993) Regulation of pathogenesis-related protein-1a gene expression in tobacco. Plant Cell 5:159-169

Hofgen, R, and Willmitzer, L (1988) Storage of competent cells for *Agrobacterium* transformation. Nucl. Acid Res. 16:9877

Schocher et al (1986) Co-transformation of foreign genes into plants. Bio/Technology 4:1093-1096

Gordon-Kamm et al (1990) Transformation of Maize Cells and Regeneration of Fertile Transgenic Plants. Plant Cell 2:603-618

Fromm et al (1990) Inheritance and expression of chimeric genes in the progeny of transgenic maize plants. Bio/Technology 8:833-839.

Koziel et al (1993) Field performance of elite transgenic maize plants expressing an insecticidal protein derived from *Bacillus thuringiensis*. Bio/Technology 11:194-200

Zhang et al (1988) Transgenic rice plants produced by electroporation-mediated plasmid uptake into protoplasts. Plant Cell Rep. 7:379-384

Shimamoto et al (1989) Fertile transgenic rice plants regenerated from transformed protoplasts. Nature 338:274-277.

Datta et al (1990) Genetically engineered fertile Indica-rice recovered from protoplasts. Bio/Technology 8:736-740

Christou et al (1991) Production of transgenic rice (*Oryza sativa* L.) plants from agronomically important indica and japonica varieties via electric-discharge particle acceleration of exogenous DNA into immature zygotic embryos. Bio/Technology 9:957-962

Vasil et al (1992) Herbicide resistant fertile transgenic wheat plants obtained by microprojectile bombardment of regenerable embryogenic callus. Bio/Technology 10:667-674

Vasil et al (1993) Rapid production of transgenic plants by direct bombardment of cultured immature embryos. Bio/Technology 11:1553-1558

Weeks et al (1993) Rapid Production of Multiple Independent Lines of Fertile Transgenic Wheat (*Triticum aestivum*). Plant Physiol. 1102:1077-1084

Murashiga et al (1962) A revised medium for rapid growth and bio-essays with tobacco tissue cultures. Physiologia Plantarum 15:473-497

Negrotto et al (2000) The use of phosphomannose isomerase as a selectable marker to recover transgenic maize plants (*Zea mays* L.) via *Agrobacterium* transformation. Plant Cell Reports 19:798-803

Eastmond, P. J., van Dijken, A. J. H., Spielman, M., Kerr, A., Tissier, A. F., Dickinson, H. G., Jones, J. D. G., Smeekens, S. C., Graham, I. A. (2002). Trehalose-6-phosphate synthase 1, which catalyses the first step in trehalose synthesis, is essential for *Arabidopsis* embryo maturation. Plant J. 29, 225-235.

Nuccio, M. L., Russell, B. L., Nolte, K. D., Rathinasabapathi, B., Gage, D. A., Hanson, D. A. (1998). The endogenous choline supply limits glycine betaine synthesis in transgenic tobacco expressing choline monooxygenase. Plant J. 16, 487-496.

Ranocha, P., McNeil, S. D., Ziemak, M. J., Li, C., Tarczynski, M. C., and Hanson, A. D. (2001). The S-methylmethionine cycle in angiosperms: ubiquity, antiquity and activity. Plant J. 25, 575-584.

Ritchie, S. W., Hanway, J. J., Benson, G. O. (1997). How a Corn Plant Develops. Special Report No. 48. Iowa State University of Science and Technology Cooperative Extension Service. Ames, Iowa.

Rontein, D., Dieuaide-Noubhani, M., Dufourc, E. J., Raymond, P., Rolin, D. (2002b). The metabolic architecture of plant cells. Stability of central metabolism and flexibility of anabolic pathways during the growth cycle of tomato cells. J. Biol. Chem. 277, 42948-43960.

Vogel, G., Aeschbacher, R. A., Müller, J., Boller, T. and Wiemken, A. (1998). Trehalose-6-phosphate phosphatases from *Arabidopsis thaliana*: identification by functional complementation of the yeast tps2 mutant. Plant J. 13, 673-683.

Wingler, A. (2002). The function of trehalose biosynthesis in plants. Phytochem. 60, 437-440.

SEQUENCE LISTING (546 sequences)

SEQ ID NO: 1 - DNA, 1027 bp, Oryza sativa
  CDS (125)..(802): OsMADS5
aagactgcaagggagagggagagagagggaagcttgcaggctgcagctaactagctaggcaaggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctgtatgtacaagacactggagcgataccgcagttgcaactacaaccttaactcatgtgaagcatctgctgcactggaaactgaactaagcaattaccaagagtacttaaagttaaagacaagagttgagttcctacaaacaactcagagaaatcttcttggcgaggacttggttccacttagcttgaaggagctcgagcaacttgagaaccagatcgagatatccctcatgaatatcaggtcatcaaagaatcaacagttgcttgatcaagtatttgagctcaaacgtaaggaacaacaacttcaagatgctaataaagacttaaaaaggaagatacaagaaactagtggagaaaatatgcttcatatatcttgccaagatgtagggcccagtggccatgctagtgaagctaaccaagagtttctccatcatgcaatttgtgacccttccctgcatatagggtatcaagcttacatggatcacctcaaccaatgaatgaattgcttatcacattaatggacatctcctatgttggatgtggtgtttgacgtaatgctctcttttacatgcgggttttaccttaagtgtgtgtgctaaatttagtgcgtttgtttatgctcttttgaactgaacaaaggaatgatcccggtttgattgatgaatgctgcaagaacataatctatatgttagtctgaattcagtatgtaatgaagatgtttt

SEQ ID NO: 2 - protein, 225 aa, Oryza sativa
MGRGKVELKRIENKISRQVTFAKRRNGLLKKAYELSVLCDAEVALIIFSTRGRLFEFSTSSCMYKTLERYRSCNYNLNSCEASAALETELSNYQEYLKLKTRVEFLQTTQRNLLGEDLVPLSLKELEQLENQIEISLMNIRSSKNQQLLDQVFELKRKEQQLQDANKDLKRKIQETSGENMLHISCQDVGPSGHASEANQEFLHHAICDPSLHIGYQAYMDHLNQ

SEQ ID NO: 3 - DNA, 1043 bp, Oryza sativa
  CDS (34)..(786): OsMADS6
tacccgcgggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaactcagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaggtggaggaacttcgcagaaaggagcgtcagctgggtgaaattaataggcaactcaagcacaagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgttt

SEQ ID NO: 4 - protein, 250 aa, Oryza sativa
MGRGRVELKRIENKINRQVTFSKRRNGLLKKAYELSVLCDAEVALIIFSSRGKLYEFGSAGITKTLERYQHCCYNAQDSNNALSETQSWYHEMSKLKAKFEALQRTQRHLLGEDLGPLSVKELQQLEKQLECALSQARQRKTQLMMEQVEELRRKERQLGEINRQLKHKLEVEGSTSNYRAMQQASWAQGAVVENGAAYVQPPPHSAAMDSEPTLQIGYPHQFVPAEANTIQRSTAPAGAENNFMLGWVL

SEQ ID NO: 5 - DNA, 5392 bp, Oryza sativa
  misc_feature (1)..(2245): 5' non-transcribed sequence
  misc_feature (1)..(5392): OsMADS5 5' regulatory sequence
  misc_feature (2246)..(2554): exon
  misc_feature (2555)..(5388): intron
  misc_feature (5389)..(5392): exon
tgagcaggtagccggcgaccaatcgcgagcgtcgccaacacgctgccttttctcaatgcatggcgtgggccccaccaggggccatttttttctctttaaaaaggagaaaagcaatcagagttgagacctccgagcgcgagacccaacatctatccctgggcccgcccaaaatccatttccaggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaaatcctaaagataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaaatcctaaagataacttcgaataaatgattaaatcttaacattttctttgaaattcatatggaacaaacaatgctatagagactttggaggaattaaagttattaagagctctaaccttttaaaagattaccaatgagtctatatcactcattcaattcctacgtttttcaaatggcctacatactcaaatggttgttcttggttttttttttctctctttcgcaattacaatggacctgctcgcaacttttgcaatctgtctatgttttttatgtttagcagctgcgctgctgcagctgaacaaaaaaaaacactgtgacgattggctgcaacacaatgaaaatgagtgcagccgaacagagccaatatcttcaaaatcttgtttttttcatcttccatttttcaatcatttattttaaaggagcccttaattaatggttaagaaattttatatcttgcattttaaaggataatgctgataatcaaatagactacggtgaaaaaaactttaaaactaaatgtaagattaaatttcacacttaaattttactagctacggctgataattaagctaacaacttactgtgactgacttggtcatagggggagagagagagagagagagagagagagagagagagagagagagagagagagagagagagagagagagagagagagagagagagagagaaaagaaggcaaggagcactccggccagcacagccgatggtacgagagcatggctagctagccgagctacttagctactacatccatgatccatccatccccaacaaacggagcaagactgcaagggagagggagagagagggaagcttgcaggctgcagctaactagctaggcaaggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctggtactactaataattctctcttgcaagctctcgccccttgcagagaattcatatatatctcgccctaattctaatgcaaagttagttaattagtttgcagccaagaaagactagttttctcgttatgagtttttgaagctccttgtgatttctgggctagctactgcccacctagctaccatgttctaattaatcatcagtccgtgtgtttaattaacatctcatgtttgtccgggaagttcttacacccagtcttttccctgctgctttgtttgtgtttaaaacatatatataccagcatttcgtttgtatttgttggaatttttaccaatctttctcaaagatcctgattttagttaatttttaccacctcgatcgtgatcatatacatgctcatagctgattaactaacctgttcctgttgttgttttggttaaagaaagagagacaggacagccgttctagtcacctgatggctgccgatctgtgtgtgtttgccgtcccctaattcctctttacggtttgcagttgccatagagactacgtactctgtcaacagaatcaagcatgcaatctctccatgcttgcttccatttgtaggctagagctgcatgctagatatctctaagctgatctcttccatgcttgtctctctagctctttcattagtgcatgcaattttcagagtgaagtagatgagacccctccagatctgcacaagaacatggcatatagtactactagtacgcatattgcatcttaattctcatattgcacaagcacatatactaggctgcagtgccttttccaatggcaagttatttttgtcagatcttaattaggagcatcttttccaatggcaagttgggagggtttcttgctctggttttactgttccattgggaactcgcaacataggggttgttcttgggttccactgttccattgagtctctctctctttctctctagctaggtttctctctctacgtcttgtcaaatgtctcggctgtactagtgtgcatgcgattgcagctgcagaagcaagaggaaaagtagtaatgcagcagcaggaggaaaagtcgtaggagtactcgtggagataagcatctctgtatcgatcgtctcgtcggttgttatcctccctgtggatatgtacacggtccgtgtttagatccaaaataattcatcaaacttttaactttttcatcacatcaaaacttttctacacacataaacttttaacttttacgtcacatcgtttcaatttcaaccaaacttctaagggcccctttgaattggaggaaaaacataggaattttagaggatttcaatcctatagaaaaatttcctatgaagccctttgaaacaaatgattgaatcctatccaatcctttgaaattcctatggaatggacaatcctatagagattttggaggaaatttagcaagagcttcaacctcttgctaactttcctttgagtctatctctctcatctaattcctgcgtttttcctgcggttcaatcaaacggtcattcatgtgtttttcctgcgttttgcaatcctctgttttacacttacattcctaccaaaatcctacgtttttcctattcctacgttttttcaatcctgcgattcaaagggaccctaattttggtgtgaactaaacacagcctagttgtagttgtgtggtacgaaagatcgaattgatttctagctaggcgtggccggacacacacccaagttaattcactgcattcgtaatttcatactcctatgcgattcataatttcacatgcgatgatgcgaatagattgatttgatcatttgaacattgtcatatggtatgcaaacaacttatcgtgcgagaggcgtgcgtgtcgattgccaaaattttctgtcagcgcacagtacaggctagctagtctggaacgaggttgtgtcgatttacaaggcacagttactagctaccctaccgttagggtatgtagtaggagtacttgtgtaccaaaagtttggattggttgaattttccaagctcctagtcacaatgtactccctccttttccctccccaaaaaatatactccttctatccagtatccacaaagaaaataatgtaactctagcatttaaaagacaaattagcaagaagtaaaatgattgggagtgaaattgtggttgggggtaaaatagggatcataatttgaatgaggggggtggttgtagggaaaaatagtactgcactcctttagaattgcacttattttgaaacaaaatctgaatgttagttacaattgtttttttctaaaaaaacagagtacaattttctaataatttaacacaaatcaatcaaatatatacatgtttgtaagtgatagtgtttatagctccaaacagggtttgaaatttcggctcgaaatttcgcccccaccgaaatgttcatatctcgcccgaaactttcggttgtttgcaaatttttgtgaatttggtcaaattttattcaaatccattcaaaatcagtcaaaaattcaaaaaaaatcgtacgaaaaaaaaatctgaaattttggttatatcgcccacctgcggtagaaatccttctttcgaaatttaaaaccctggctccaaacttagggtgcgctgtgcacataccctagaaaatataactgatatatgctccattaattatgaaaggcaaaataaactgatcatgcatatgtaggaaaatcgggttgtatatacatgtatttaaacaacaaaatataatataacaactttaactgatactgcattgaaaatagttttgtggtccactgattttcttttttgtaacagtatg

SEQ ID NO: 6 - DNA, 5412 bp, Oryza sativa
  misc_feature (1)..(5412): OsMADS5 5' regulatory sequence engineered
  misc_feature (1)..(13): Engineered sequence
  misc_feature (1)..(2258): 5'-nontranscribed sequence
  misc_feature (2259)..(2567): Exon
  misc_feature (2379)..(2384): Engineered sequence
  misc_feature (2568)..(5400): intron
  misc_feature (5401)..(5412): partial exon
  misc_feature (5404)..(5412): Engineered sequence
ctcgaggcgcgcctgagcaggtagccggcgaccaatcgcgagcgtcgccaacacgctgccttttctcaatgcatggcgtgggccccaccaggggccatttttttctctttaaaaaggagaaaagcaatcagagttgagacctccgagcgcgagacccaacatctatccctgggcccgcccaaaatccatttccaggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattagatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaaatcctaaagataacttcgaataaatgattaaatcttaacattttctttgaaattcatatggaacaaacaatgctatagagactttggaggaattaaagttattaagagctctaaccttttaaaagattaccaatgagtctatatcactcattcaattcctacgtttttcaaatggcctacatactcaaatggttgttcttgttttttttttctctctttcgcaattacaatggacctgctcgcaacttttgcaatctgtctatgttttttatgtttagcagctgcgctgctgcagctgaacaaaaaaaaacactgtgacgattggctgcaacacaatgaaaatgagtgcagccgaacagagccaatatcttcaaaatcttgtttttttcatcttccatttttcaatcatttattttaaaggagcccttaattaatggttaagaaattttatatcttgcattttaaaggataatgctgataatcaaatagactacggtgaaaaaaactttaaaactaaatgtaagattaaatttcacacttaaattttactagctacggctgataattaagctaacaacttactgtgactgacttggtcatagggggagagagagagagagagagagagagagagagagagagagagagagagagagagagagagagagagagagagagagagagagagagagagaaaagaaggcaaggagcactccggccagcacagccgatggtacgagagcatggctagctagccgagctacttagctactacatccatgatccatccatccccaacaaacggagcaagactgcaagggagagggagagagagggaagcttgcaggctgcagctaactagctaggcaaggagagagaggagatagatcaagaagagattttgagaccgagagagagctagagagagctcgacggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctggtactactaataattctctcttgcaagctctcgccccttgcagagaattcatatatatctcgccctaattctaatgcaaagttagttaattagtttgcagccaagaaagactagttttctcgttatgagtttttgaagctccttgtgatttctgggctagctactgcccacctagctaccatgttctaattaatcatcagtccgtgtgtttaattaacatctcatgtttgtccgggaagttcttacacccagtcttttccctgctgctttgtttgtgtttaaaacatatatataccagcatttcgtttgtatttgttggaatttttaccaatctttctcaaagatcctgattttagttaatttttaccacctcgatcgtgatcatatacatgctcatagctgattaactaacctgttcctgttgttgttttggttaaagaaagagagacaggacagccgttctagtcacctgatggctgccgatctgtgtgtgtttgccgtcccctaattcctctttacggtttgcagttgccatagagactagtactctgtcaacagaatcaagcatgcaatctctccatgcttgcttccatttgtaggctagagctgcatgctagatatctctaagctgatctcttccatgcttgtctctctagctctttcattagtgcatgcaattttcagagtgaagtagatgagacccctccagatctgcacaagaacatggcatatagtactactagtacgcatattgcatcttaattctcatattgcacaagcacatatactaggctgcagtgccttttccaatggcaagttatttttgtcagatcttaattaggagcatcttttccaatggcaagttgggagggtttcttgctctggttttactgttccattgggaactcgcaacataggggttgttcttgggttccactgttccattgagtctctctctctttctctctagctaggtttctctctctacgtcttgtcaaatgtctcggctgtactagtgtgcatgcgattgcagctgcagaagcaagaggaaaagtagtaatgcagcagcaggaggaaaagtcgtaggagtactcgtggagataagcatctctgtatcgatcgtctcgtcggttgttatcctccctgtggatatgtacacggtccgtgtttagatccaaaataattcatcaaacttttaactttttcatcacatcaaaacttttctacacacataaacttttaacttttacgtcacatcgtttcaatttcaaccaaacttctaagggcccctttgaattggaggaaaaacataggaattttagaggatttcaatcctatagaaaaatttcctatgaagccctttgaaacaaatgattgaatcctatccaatcctttgaaattcctatggaatggacaatcctatagagattttggaggaaatttagcaagagcttcaacctcttgctaactttcctttgagtctatctctctcatctaattcctgcgtttttcctgcggttcaatcaaacggtcattcatgtgtttttcctgcgttttgcaatcctctgttttacacttacattcctaccaaaatcctacgtttttcctattcctacgttttttcaatcctgcgattcaaagggaccctaattttggtgtgaactaaacacagcctagttgtagttgtgtggtacgaaagatcgaattgatttctagctaggcgtggccggacacacacccaagttaattcactgcattcgtaatttcatactcctatgcgattcataatttcacatgcgatgatgcgaatagattgatttgatcatttgaacattgtcatatggtatgcaaacaacttatcgtgcgagaggcgtgcgtgtcgattgccaaaattttctgtcagcgcacagtacaggctagctagtctggaacgaggttgtgtcgatttacaaggcacagttactagctaccctaccgttagggtatgtagtaggagtacttgtgtaccaaaagtttggattggttgaattttccaagctcctagtcacaatgtactccctccttttccctccccaaaaaatatactccttctatccagtatccacaaagaaaataatgtaactctagcatttaaaagacaaattagcaagaagtaaaatgattgggagtgaaattgtggttgggggtaaaatagggatcataatttgaatgaggggggtggttgtagggaaaaatagtactgcactcctttagaattgcacttattttgaaacaaaatctgaatgttagttacaattgtttttttctaaaaaaacagagtacaattttctaataatttaacacaaatcaatcaaatatatacatgtttgtaagtgatagtgtttatagctccaaacagggtttgaaatttcggctcgaaatttcgcccccaccgaaatgttcatatctcgcccgaaactttcggttgtttgcaaatttttgtgaatttggtcaaattttattcaaatccattcaaaatcagtcaaaaattcaaaaaaaatcgtacgaaaaaaaaatctgaaattttggttatatcgcccacctgcggtagaaatccttctttcgaaatttaaaaccctggctccaaacttagggtgcgctgtgcacataccctagaaaatataactgatatatgctccattaattatgaaaggcaaaataaactgatcatgcatatgtaggaaaatcgggttgtatatacatgtatttaaacaacaaaatataatataacaactttaactgatactgcattgaaaatagttttgtggtccactgattttcttttttgtaacagtatccaccatgg

SEQ ID NO: 7 - DNA, 124 bp, Oryza sativa
  misc_feature (1)..(124): OsMADS5 5'-untranslated leader sequence - natural
aagactgcaagggagagggagagagagggaagcttgcaggctgcagctaactagctaggcaaggagagagaggagatagatcaagaagagattttgagaccgagagagagctagagagagatcg

SEQ ID NO: 8 - DNA, 317 bp, Oryza sativa
  misc_feature (1)..(317): OsMADS5 5'-untranslated leader sequences - engineered
  misc_feature (121)..(125): engineered sequence
  misc_feature (313)..(317): Engineered sequence
aagactgcaagggagagggagagagagggaagcttgcaggctgcagctaactagctaggcaaggagagagaggagatagatcaagaagagattttgagaccgagagagagctagagagagctcgacggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctgtatccacc

SEQ ID NO: 9 - DNA, 1215 bp, Oryza sativa
  misc_feature (1)..(1215): OsMADS5 terminus
  misc_feature (1)..(228): 3'-untranslated sequence
  misc_feature (229)..(1215): 3'-nontranscribed sequence
atgaattgcttatcacattaatggacatctcctatgttggatgtggtgtttgacgtaatgctctcttttacatgcgggttttaccttaagtgtgtgtgctaaatttagtgcgtttgtttatgctcttttgaactgaacaaaggaatgatcccggtttgattgatgaatgctgcaagaacataatctatatgttagtctgaattcagtatgtaatgaagatgttttgttactaattaataaatacgaagtaaacaattaactgaccactaatcatgtcagcttagatatatgcttataattatgttgcctaattcttaccttaattggtctgtgttcaatatatgtgagtataccacactagttgtttctcagcatgaactaattaagtgtgagtagataaaacgagtaaattggaatgtaagaaaaggtaaaaataaagtacttattaaagagagagtgcatgccaaaagtacgaagagaaaaacttagaatattagttacaatataatatataatcaagtgcttcgttcgaacccatacatgtttgtttttcttatttttctaatatttcttcaccatataggttccccaggttgcactccgaaaggtcgtgtaatgtgtatttagtagcacacatagttacatcactgcttattttctcatccactagccacaagattgtgtgcgtgtgaccatctcaattagatccatctcctccttcacatgcacggtattgatttgtgctagacctgccggtgtctccaatggtgatgatccagctgattcatcgtcttggaggacatcatcgtcccatgccatttccatatctatctcatggccaatcttgttagcataatcaatgtggttgaagatgtagttcatgtcaacatcatcatctatgttgtaaacctggtacggcatctcgtccttcgtttcgaacaaatgatcacacatatcaaggcataaatcatcataggtagagaccaggagttcttcacaagagttggtctggatgtagctgttctcatccatggtgagtattccctgggtgaccatttggttggatgggttggaatctggcctgatcttaccattcacctctgctaacttttgtgtggatgctggtgaagacgatgacactgcagtagattctggtggagcttgacgaacacttgacttgattggaccaattccaaggctcttgatgtagttttg

SEQ ID NO: 10 - DNA, 1089 bp, Oryza sativa
  misc_feature (1)..(1089): OsMADS5 3'-regulatory sequence engineered
  misc_feature (1)..(31): engineered sequence
  misc_feature (1)..(275): 3'-untranslated sequence
  misc_feature (276)..(1089): 3'-nontranscribed sequence
  misc_feature (1078)..(1089): Engineered sequence
gagctccgcgggcggccgcactagtcccgggccatggggggtctagaatgaattgcttatcacattaatggacatctcctatgttggatgtggtgtttgacgtaatgctctcttttacatgcgggttttaccttaagtgtgtgtgctaaatttagtgcgtttgtttatgctcttttgaactgaacaaaggaatgatcccggtttgattgatgaatgctgcaagaacataatctatatgttagtctgaattcagtatgtaatgaagatgttttgttactaattaataaatacgaagtaaacaattaactgaccactaatcatgtcagcttagatatatgcttataattatgttgcctaattcttaccttaattggtctgtgttcaatatatgtgagtataccacactagttgtttctcagcatgaactaattaagtgtgagtagataaaacgagtaaattggaatgtaagaaaaggtaaaaataaagtacttattaaagagagagtgcatgccaaaagtacgaagagaaaaacttagaatattagttacaatataatatataatcaagtgcttcgttcgaacccatacatgtttgtttttcttatttttctaatatttcttcaccatataggttccccaggttgcactccgaaaggtcgtgtaatgtgtatttagtagcacacatagttacatcactgcttattttctcatccactagccacaagattgtgtgcgtgtgaccatctcaattagatccatctcctccttcacatgcacggtattgatttgtgctagacctgccggtgtctccaatggtgatgatccagctgattcatcgtcttggaggacatcatcgtcccatgccatttccatatctatctcatggccaatcttgttagcataatcaatgtggttgaagatgtagttcatgtcaacatcatcatctatgttgtaaacctggtacggcatctcgtccttcgtttcgaacaaatgatcacacatatcaaggcataaatcatcataggtagagaccaggagttcttcacaagagttggtctggatgtagctgttctcatccggcgcgcccggg

SEQ ID NO: 11 - DNA, 4450 bp, Oryza sativa
  misc_feature (1)..(4450): OsMADS6
  misc_feature (1)..(1460): 5'-nontranscribed sequence
  misc_feature (1168)..(1168): r is a or g
  misc_feature (1461)..(1667): exon
  misc_feature (1668)..(4425): intron
  misc_feature (2577)..(2579): k is g or t
  misc_feature (2580)..(2580): y is c or t
  misc_feature (4426)..(4450): exon
gacgatggtgtgatgtgggaacacgaagaaaacatgaggaaaaaatattaaaatgaatttcccacttaaaatgcatcaaataaaaaaaataaagaaacgaccgggaatagacacaggatttgtgaactagctagggcaaacatcatatggtcccttgctgatgcacaagtacattgagatgtcatttcaattctgtgcatcatatgcatgtggtcccttgctgaatattactcttgaaatatctaccagtgccaatctattgcatgacttaattaattcacaggttttgttgattacattattagtaagcttgagagcacaagctcaatggatttttctataaatggggatcattttgcaattttctttgtcgtgcaaagttagccttctttattactacttctgtttttaaatatacgatcctattgacttttggtcatatatttaaccatgtatcttatttagatagtttgcgcaaatatatataccttcaatgataaaattagttacaatgaaacaaatgatatttacgcaattctttttactaaacaagtcacaagaagtacctgcagcaatatatgttggaaccgtgcagtagatcgagcctagctacgcaaaaaaacaaaaagagaaaaaaagggaaaggaaaaacattaatcatgcatgagcagtatgcccggcaactggaatttgtcaaagatatggggagaggagaataatacaagtactactactacctagctctaccatgcatatgcacccaaaggcaaactggattattggataaagcacagatgctggcaaaacaatccttaagcctcccctccctgcttctttatttttgggcagcctctaccggacggtgccgtggtccattggaccagtaggtggcgacatacatggtttgggttaagtctaggagagcagtgtgtgtgcgcgcgcaagagagagagactgtgagtctgggagtagccctctcccctcctttggccatcttcctcgtgtatatgcatatatgcatcatcgcaacggtgtatatttgtggtgtggcgggtgtggcattggattgcccccattttggctcgtgcttcccagttagggtaaaacctgtggtaaacttgctagccccacgccaaagttacccttctttattgttgaaagggagagraggtgtgtgaattgtgatggagggagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccatcaggggagccccttctggtattaagatctttccggcacattgattttcatactttgtgatgaccctggaagaatcggcgtagcagcgtagcaccgctccattttggtcttaccctcacctccccatgctatgaactgatcaatttcattgttcttcatcacccttctcctagctttccacttccttcggatctcatgccatgtttctcagcatgaatcaaatttaattcgtgttttctacttccatatatactggaagaaatttaattagatctatttttgctcgggaggtcttcatactttgagttctgatgccatcaccttatttccccccccccyttctctkgktctatcttcttcctcatcttggcttgatcattttgatctgtcagttatagcatgatgcattctcaatttgactgtatgtaagttcaaccggaaatatgttgaatggattttctatatatcaacacttgatgtcaggcctgcatctgtttcgcttgtggtggtgtggccaaaattgtctatatttgatctttgctcttctttctcctcatttcatgacgattcctactacggcttaaaccattctttattctttactaatcatggatgttgcttgactcctagttgtttcgtactagctcaacttggagatcttttcattatttgcctagttggtgggtacgtttgtgacagatctaaaatggtgcacgaaaagttttacttattatgaaaaaagggagcttaacagggtaatttctctatttattcgtgatgacattttttccttgataagggggattttttataatctgcactcacatgtttatatgtaaaatctagctcttttgttttgtttttggcatatttcccgctaagtatagagtttatgtggataacattataacttttcaagatccaatccacatctttgattgtgaaaatcatacaatagggaaaatcaactgaagggttaattagatgctatatgcatatatatatatatgtgcgcgcgcgcgcgcctgaatttaactatgtatgcatccaactgtttcattgaaaaagatttgatatttttcagtctattctttttcgagtatatatttaatatgtttcaatctgttttgaccattataagataaagcctatattcaccaggcatttgagatgatcttttcatgcatgaaaaagctgttgttatcacttcaactaaccagacgatctaacatgtatttgtataagaaacagaccttgatttccttctgtaaaatcatgcatgtgttcgttttgaattggagtcggcgcgcctgtgttttgaccgtcaggaaagtcttttttttccctgaatagtcaagggtctatacttcttgaagcaattgggacactaatcaattattgtttatacctcggaccatcttttccttcttcacaccactaatcagtttatgccttggaccattaattgtgttgttcacaagcttcttgtttatggtttacaaagcattcgcctagatttgtgtgtgtctctacacatcgatcacttttaaatacttgtcgctttcagttattcttttaacgtttggttatttatcttatttaaaaaaattatcgtattattatttattttgtttgtgatttactttattatcaaaagtatttcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgcagcataacaaagactttagaaaggtac

SEQ ID NO: 12 - DNA, 4457 bp, Oryza sativa
  misc_feature (1)..(4457): OsMADS6 5'-regulatory sequence
  misc_feature (1)..(12): Engineered sequence
  misc_feature (1)..(1478): 5'-nontranscribed sequence
  misc_feature (1479)..(1685): exon
  misc_feature (1503)..(1508): Engineered Sequence
  misc_feature (1529)..(1529): Mutagenized sequence position
  misc_feature (1686)..(4443): intron
  misc_feature (4444)..(4457): exon
  misc_feature (4450)..(4457): Engineered sequence
gcatgcggaccgctaggacgatggtgtgatgtgggaacacgaagaaaacatgaggaaaaaatattaaaatgaatttcccacttaaaatgcatcaaataaaaaaaataaagaaacgaccgggaatagacacagggtttgtgaactagctagggcaaacatcatatggtcccttgctgatgcacaagtacattgagatgtcatttcaattctgtgcatcatatgcatgtggtcccttgctgaatattactcttgaaatatctaccagtgccaatctattgcatgacttaattaattcacaggttttgttgattacattattagtaagcttgagagcacaagctcaatggatttttctataaatggggatcattttgcaattttctttgtcgtgcaaagttagccttctttattactacttctgtttttaaatatacgatcctattgacttttggtcatatatttaaccatgtatcttatttagatagtttgcgcaaatatatataccttcaatgataaaattagttacaatgaaacaaatgatatttacgcaattctttttactaaacaagtcacaagaagtacctgcagcaatatatgttggaaccgtgcagtagatcgagcctagctacgcaaaaaaacaaaaagagaaaaaaagggaaaggaaaaacattaatcatgcatgagcagtatgcccggcaactggaatttgtcaaagatatggggagaggagaataatacaagtactactactacctagctctaccatgcatatgcacccaaaggcaaactggattattggataaagcacagatgctggcaaaacaatccttaagcctcccctccctgcttctttatttttgggcagcctctaccggacggtgccgtggtccattggaccagtaggtggcgacatacatggtttgggttaagtctaggagagcagtgtgtgtgcgcgcgcaagagagagagactgtgagtctgggagtagccctctcccctcctttggccatcttcctcgtgtatatgcatatatgcatcatcgcaacggtgtatatttgtggtgtggcgggtgtggcattggattgcccccattttggctcgtgcttcccagttagggtaaaacctgtggtaaacttgctagccccacgccaaagttacccttctttattgttgaaagggagaggaggtgtgtgaattgtgatggagggagagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgagtcgacgaggggaagagttgagctgaggcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccatcaggggagccccttctggtattaagatctttccggcacattgattttcatactttgtgatgaccctggaagaatcggcgtagcagcgtagcaccgctccattttggtcttaccctcacctccccatgctatgaactgatcaatttcattgttcttcatcacccttctcctagctttccacttccttcggatctcatgccatgtttctcagcatgaatcaaatttaattcgtgttttctacttccatatatactggaagaaatttaattagatctatttttgctcgggaggtcttcatactttgagttctgatgccatcaccttatttcccccccccccttctcttgttctatcttcttcctcatcttggcttgatcattttgatctgtcagttatagcatgatgcattctcaatttgactgtatgtaagttcaaccggaaatatgttgaatggattttctatatatcaacacttgatgtcaggcctgcatctgtttcgcttgtggtggtgtggccaaaattgtctatatttgatctttgctcttctttctcctcatttcatgacgattcctactacggcttaaaccattctttattctttactaatcatggatgttgcttgactcctagttgtttcgtactagctcaacttggagatcttttcattatttgcctagttggtgggtacgtttgtgacagatctaaaatggtgcacgaaaagttttacttattatgaaaaaagggagcttaacagggtaatttctctatttattcgtgatgacattttttccttgataagggggattttttataatctgcactcacatgtttatatgtaaaatctagctcttttgttttgtttttggcatatttcccgctaagtatagagtttatgtggataacattataacttttcaagatccaatccacatctttgattgtgaaaatcatacaatagggaaaatcaactgaagggttaattagatgctatatgcatatatatatatatgtgcgcgcgcgcgcgcctgaatttaactatgtatgcatccaactgtttcattgaaaaagatttgatatttttcagtctattctttttcgagtatatatttaatatgtttcaatctgttttgaccattataagataaagcctatattcaccaggcatttgagatgatcttttcatgcatgaaaaagctgttgttatcacttcaactaaccagacgatctaacatgtatttgtataagaaacagaccttgatttccttctgtaaaatcatgcatgtgttcgttttgaattggagtcggcgcgcctgtgttttgaccgtcaggaaagtcttttttttccctgaatagtcaagggtctatacttcttgaagcaattgggacactaatcaattattgtttatacctcggaccatcttttccttcttcacaccactaatcagtttatgccttggaccattaattgtgttgttcacaagcttcttgtttatggtttacaaagcattcgcctagatttgtgtgtgtctctacacatcgatcacttttaaatacttgtcgctttcagttattcttttaacgtttggttatttatcttatttaaaaaaattatcgtattattatttattttgtttgtgatttactttattatcaaaagtatttcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgcagcataaccaccatgg

SEQ ID NO: 13 - DNA, 25 bp, Oryza sativa
  misc_feature (1)..(28): OsMADS6 5'-untranslated sequence
ggaatcgttcgatcgatcgggcgag

SEQ ID NO: 14 - DNA, 217 bp, Oryza sativa
  misc_feature (1)..(221): OsMADS6 5'-untranslated sequence - engineered
  misc_feature (25)..(30): Engineered sequence
  misc_feature (51)..(51): Mutagenized position
  misc_feature (214)..(221): Engineered sequence
ggaatcgttcgatcgatcgggcgagtcgacgaggggaagagttgagctgaggcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataaccacc

SEQ ID NO: 15 - DNA, 1241 bp, Oryza sativa
  misc_feature (1)..(1241): OsMADS6 3'-regulatory sequence
  misc_feature (1)..(257): 3'-untranslated sequence
  misc_feature (258)..(1241): 3'-non-transcribed sequence
gctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagttgttttaactttagtcaaagttaaactgtttcaagtttaaccaagtttgtagataaaagtagtaacatattcaacacaagacaaatatattataaaaacatattgaattatagatttaattaaattaatttggtattgcaagtattactaaatttgtttataaatttggtcgaatttaaaatagtttgactttaaccaaagtcaaaacaaattataatctaaaacaaaggtaatacattgtatcactctcatgaatggattgtaacatacattaatttaattactattttagttcttgtgcaaaagttgaaaacgatttatgtttggaatctttttgtggtgtatatatatgaaaccattcctctaccatccttccccaaccataatcctcacaaccgttagccccattgtgatctcacccagttgctagcctcttttgtcaccttgtcacagctctcctccattcattacacaatggcatc

SEQ ID NO: 16 - DNA, 1293 bp, Oryza sativa
  misc_feature (1)..(1293): OsMADS6 3'- regulatory sequence engineered
  misc_feature (1)..(42): Engineered sequence
  misc_feature (1)..(299): 3'-untranslated sequence
  misc_feature (300)..(1293): 3'-nontranscribed sequence
  misc_feature (1283)..(1293): 3'-nontranscribed sequence
acgtgagctccgcgggcggccgcactagtcccacgtgagctcgctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagtcgttttaactttagtcaaagttaaactgtttcaagtttaaccaagtttgtagataaaagtagtaacatattcaacacaagacaaatatattataaaaacatattgaattatagatttaattaaattaatttggtattgcaagtattactaaatttgtttataaatttggtcgaatttaaaatagtttgactttaaccaaagtcaaaacaaattataatctaaaacaaaggtaatacattgtatcactctcatgaatggattgtaacatacattaatttaattactattttagttcttgtgcaaaagttgaaaacgatttatgtttggaatctttttgtggtgtatatatatgaaaccattcctctaccatccttccccaaccataatcctcacaaccgttagccccattgtgatctcacccagttgctagcctcttttgtcaccttgtcacagctctcctccattcattacacaatggcatcggtccgcagt

SEQ ID NO: 17 - DNA, 1179 bp, Oryza sativa
  CDS (109)..(855): OsMADS8
gctttcccctctcttccgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattcagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaactggaggagagcaaccagttgcatggacaagtgtgggagcacggcgccaccctactcggctacgagcggcagtcgcctcatgccgtccagcaggtgccaccgcacggtggcaacggattcttccattccctggaagctgccgccgagcccaccttgcagatcgggtttactccagagcagatgaacaactcatgcgtgactgccttcatgccgacatggctaccctgaactcctgaaggccgatgcgacaaccaataaaaacggatgtgacgacacagatcaagtcgcaccattagattgatcttctcctacaagagtgagactagtaattccgcgtttgtgtgctagcgtgttgaaacttttctgatgtgatgcacgcacttttaattattattaagcgttcaaggactagtatgtggtataaaagcccgtacgtgacagcctatggttatatgctgcgcaaaaactacgtatggtacagtgcagtgcctgtacatttcataatttgcgggtaaagtttattgactatatatccagtgtgtcaaatataat

SEQ ID NO: 18 - protein, 248 aa, Oryza sativa
MGRGRVELKRIENKINRQVTFAKRRNGLLKKAYELSVLCDAEVALIIFSNRGKLYEFCSGQSMTRTLERYQKFSYGGPDTAIQNKENELVQSSRNEYLKLKARVENLQRTQRNLLGEDLGTLGIKELEQLEKQLDSSLRHIRSTRTQHMLDQLTDLQRREQMLCEANKCLRRKLEESNQLHGQVWEHGATLLGYERQSPHAVQQVPPHGGNGFFHSLEAAAEPTLQIGFTPEQMNNSCVTAFMPTWLP

SEQ ID NO: 19 - DNA, 5229 bp, Oryza sativa
  misc_feature (1)..(5229): OsMADS8 5'-regulatory sequence
  misc_feature (1)..(2303): 5'-nontranscribed sequence
  misc_feature (2304)..(2596): exon
  misc_feature (2597)..(5203): intron
  misc_feature (5204)..(5229): exon
ccattttttgcgaaatgccaaatcctggcatgcctaagctgacctgagcttgtagttttcaaacgaaccgtgttaattgtggtatataacacattgggttggctactgtatcgtacataattttgttggggttatttctgcatgcgtatacgtacggattagttgtaattaagaggaaaaacatgcatgtataatatagatatacctagcatgcaccattatatacttattaatctaagctttaaagtgcaaatgatactacatattgaacattcaactttattgtattgataaattgaaccggatatatccacaagcacaaaatttgcaatgcacttcaaaattaatgtaatctttgcacgctactccctacatttcatattataagttgatttgactttttttttcaagtttataaaaaaaattagcaacatctaaaatatcaaattagtttcacttaatctaacattgaatatatttagatactacgtttgttttatcttaaaaatgttagtatgttttttttataaacttggtcagcctttgaaatgttggactagaaaaaaaggtaaaaaaaattataatgctgaataagccacaatttaaaaagtttacagggacggtttaattcattgacatttcacatatacatagcacatgtcaaattcatatgttaacttttctttttataaactggacaccccgtgccaacagtcaacccctaattaaattaaccacaacatgaatacatcattaattttataacatatactagttattttgcttttcatatatctccccctcttgctaatttgagttcccagcatgcatggatactaattaacttaaccaaaattagttagcctgcagcctaatttgtccatctctagctagctagtttgcacttaacatctgtgatacgttaccacaccaaagttacatacacattaatgattaatcctttgatcagttcctatatatcccaggtagaatatatatcgatctcttcagaatcacgaccaattaggtaaaatgaaagaacatacactcctgcctagccaagacttcaaaccttacacacacatatatatctactactgcaagcactgcaacggcaaagttctctgcaggcaaagagatataccgatcgaagaagcctctctctatccaaacccaaacagctccattttgtctacacgaactatggcaacttggcaaccacatcgctagctagctagatatatactatgctaccttggttcattttgctgctttgatttgcaactgcaacccaagagaaaagttgtaagggtctgtatggggattttctgaccgctgtatcttctctcaaaatcatattaatcctctctacatagtctagtttttcatccaaattctcaaaagctctaattatagaatctaaaaaattaactagaaaacagaagctgagaaatccacattctccatattctcagaagcttgatactaactagctatttcccaaaatcttaggccttatttagttggggaaaatttttgggtttgtttgtcacattggatatacggacacacattagtattaaatgtggtacaataacaaaacaaattacagattccgtcaaaaaactgcaagacaaatttattgagctcaattaatccgtcattagcaaatgtttactgcagcaccacattgtcaaatcaggcgcaattagacttaaaagattcgtctcgtaatttacacgcaaattgtgtaactggttttttttccacatttaatactccatgcatgtatttaaatattcgatgtgatgggtgaaaattgtttattttggaaactaaacaaagccttaagctctcccaacagatcacccaccggctcctagtggacacaagaagggtatttttcccgaaacccgaaaactccgaggtttcaagtgcaaaagcgcccaactctactcacttttccccagcttttccgcgcttaatttctcgacctgtcgaatcctcagtcgccaccgctgcgtcgacgaggagagagagagagagagagagagagagagaaaatccaaagcaatcagtgagagacgcattgaattgggtcggagattagtgcgaaattaacctagatagctttgcctttgcgtacgatggatcgatcgaggccgcctagggttccgcgtcgttccaccaccttgccggaaatggcaatgccgggtagcccccaccgccgctgcccaccctctcccccttccctttttaaacccctcatccccttccccctcctcctcctcctcctcgccttagctttcccctctctttcgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaaggtatatatacatggacgcactgggcgcgcgcctcgatctgctatagctagatcggtagctgcttgcaacgtagctagctagggtttcttgcgcgcgcctgcgcctccagatctggagcgcacgatggttttgtgaacttcttggtggcgattttgcggggatctggggctgcacatggtggatctgcgagtgtgctcgtgttttggtgagttttgggagggtttgggagaaggaagttggtggaattctgtgggaataattagggtttttgttcgttcgatcgggtgctagctagcgtaatagggagtggtgaaatacgtagatctgagggtttctgatcccgtggtagtagtggttttgagatggcgcgcttaatggttttgagtttggtttaattgcgattaatttatgtgcatgcatgggatgggacattcaggatttaagcctggatcagcaagtcgatttttacggagaaaattaatcgttggaagcttcgaatcttaattttatcgatctcctaatggagggtatgcgagtttcgaattcccttgggatctgtttttttcctcaatttttagttttttgaggggcaattttttttagggtatatatgattttttttttttgggggggggggggtgtgtgaagggatcatgcatatcattagccatgtaccggatgtgtgtctaaacaaacgttcactgcatgaattccacggtttggaggcagcataccttacaagatttgggggtttcacttaagattttgtctctttgtttttttaagggatggccgcgggggagtattgtttttcaagtgagttatggttgcatcattaaaggcaacatcaataaatataaagtctgtttctcctgagataagtatatgaaaaatcatatactactatatatataattgtctttcagaaacacagagcgtctgattggctaggcataattcacaagccgcatataagctagttgaattgattttgaattagaaaacattttttttcggggggaagaaaacatttggtattgtgtttagagataaacaattagttagggtagataagtcaggcattcatgagcttcatttcatatttgaatcatacattttccaaactttagaaggttaaattttcttgctcattgtattgcactgatcattttaataatatcttctatagtgaatattacatcattatatattttagataatgattacattattatatgctccgttgcagaaaaaaccaacttttttgccaaacctggacatatataggctatgtccagatttatagctagaagttagggcctcatcttttaccctatgaattataagccaatatcaaattttgaatttcgaaacttgatttagaagttgatttttaatgttttgtcaatgtagattgtttttcagcattaacttttaattcgctaaagacacatatacaattttactcacaaattatattttggttgctaataagccgttatggcttataatcagccgtaagtatatggggactttagcattctttttctttttttatggagggagtacatgcttgccaatttttatagttatgtttaaatggtttccattatacctaagttactaaattaaaattaatacgcctataaaattctaacattaaatatattcacaaataagagtacatgatttcattgaccagggaattcaatttggatatggggtgagtgaaacatccctcctctgctcctcggaagaaatcctgcaagggagtacacaatattcctaggactcacttgagtatctgcagggtacagttagtgacagctttcgattgtcattcgattggtctcctcagctctcgtagctgagctgtcagtacagaagattggtcttcatcagatgtctcttctagttctagctagagctagttcagtggagtattttatgccgacaaattgatactcaacgtgtactgtagatccttttcagaaatctgaattcacgacttgtttaaacaaaggctgtgtttggatccaaacttcagtccttttccattacatcaacctgtcatatacacacaacattttagtcatatcatctccaatttcaaccaaaatctaaactttgcgttgaactaaacacagccaaaaggtcactaaattgacgcggtagaggggggggggtgagcattatagctgtagtagtagtctgcgtgaagttatgccatttcattgtgtgtcgtctgaacttgatatctctctttaaagagtgtactccattttctttacaaaaagtggcctctaggttgatatcatggacatatataaaattataaatcaacttgaaactaccgatgcaagaattaagataaaacgttattgtttcttagaaattgtctccaattatgcaagcaccttcatccgtgtcatggagctaatgttcatgttttgtgggaaacaagatttttcatctactaattaatcgatgtggtccccggaaaagaatgtgccctagattgttagtatttagttatgggcgaactatatatgttcctttatttcgtttttccataaacatagccatttgtgtttttgaaacttgcagcatgaccagaactttggaaagatacc

SEQ ID NO: 20 - DNA, 5226 bp, Oryza sativa
  misc_feature (1)..(5226): OsMADS8 5' regulatory sequence engineered
  misc_feature (1)..(15): Engineered sequence
  misc_feature (1)..(2315): 5'-nontranscribed sequence
  misc_feature (2316)..(2605): Exon
  misc_feature (2420)..(2425): Engineered sequence
  misc_feature (2606)..(5212): Intron
  misc_feature (5213)..(5226): Exon
  misc_feature (5214)..(5214): Mutagenized base pair
  misc_feature (5221)..(5226): Engineered Sequence
cctgcaggcggaccgttttttgcgaaatgccaaatcctggcatgcctaagctgacctgagcttgtagttttcaaacgaaccgtgttaattgtggtatataacacattgggttggctactgtatcgtacataattttgttggggttatttctgcatgcgtatacgtacggattagttgtaattaagaggaaaaacatgcatgtataatatagatatacctagcatgcaccattatatacttattaatctaagctttaaagtgcaaatgatactacatattgaacattcaactttattgtattgataaattgaaccggatatatccacaagcacaaaatttgcaatgcacttcaaaattaatgtaatctttgcacgctactccctacatttcatattataagttgatttgactttttttttcaagtttataaaaaaaattagcaacatctaaaatatcaaattagtttcacttaatctaacattgaatatatttagatactacgtttgttttatcttaaaaatgttagtatgttttttttataaacttggtcagcctttgaaatgttggactagaaaaaaaggtaaaaaaaattataatgctgaataagccacaatttaaaaagtttacagggacggtttaattcattgacatttcacatatacatagcacatgtcaaattcatatgttaacttttctttttataaactggacaccccgtgccaacagtcaacccctaattaaattaaccacaacatgaatacatcattaattttataacatatactagttattttgcttttcatatatctccccctcttgctaatttgagttcccagcatgcatggatactaattaacttaaccaaaattagttagcctgcagcctaatttgtccatctctagctagctagtttgcacttaacatctgtgatacgttaccacaccaaagttacatacacattaatgattaatcctttgatcagttcctatatatcccaggtagaatatatatcgatctcttcagaatcacgaccaattaggtaaaatgaaagaacatacactcctgcctagccaagacttcaaaccttacacacacatatatatctactactgcaagcactgcaacggcaaagttctctgcaggcaaagagatataccgatcgaagaagcctctctctatccaaacccaaacagctccattttgtctacacgaactatggcaacttggcaaccacatcgctagctagctagatatatactatgctaccttggttcattttgctgctttgatttgcaactgcaacccaagagaaaagttgtaagggtctgtatggggattttctgaccgctgtatcttctctcaaaatcatattaatcctctctacatagtctagtttttcatccaaattctcaaaagctctaattatagaatctaaaaaattaactagaaaacagaagctgagaaatccacattctccatattctcagaagcttgatactaactagctatttcccaaaatcttaggccttatttagttggggaaaatttttgggtttgtttgtcacattggatatacggacacacattagtattaaatgtggtacaataacaaaacaaattacagattccgtcaaaaaactgcaagacaaatttattgagctcaattaatccgtcattagcaaatgtttactgcagcaccacattgtcaaatcaggcgcaattagacttaaaagattcgtctcgtaatttacacgcaaattgtgtaactggttttttttccacatttaatactccatgcatgtatttaaatattcgatgtgatgggtgaaaattgtttattttggaaactaaacaaagccttaagctctcccaacagatcacccaccggctcctagtggacacaagaagggtatttttcccgaaacccgaaaactccgaggtttcaagtgcaaaagcgcccaactctactcacttttccccagcttttccgcgcttaatttctcgacctgtcgaatcctcagtcgccaccgctgcgtcgacgaggagagagagagagagagagagagagagagaaaatccaaagcaatcagtgagagacgcattgaattgggtcggagattagtgcgaaattaacctagatagctttgcctttgcgtacgatggatcgatcgaggccgcctagggttccgcgtcgttccaccaccttgccggaaatggcaatgccgggtagcccccaccgccgctgcccaccctctcccccttccctttttaaacccctcatccccttccccctcctcctcctcctcctcgccttagctttcccctctctttcgcttcgcgagattggttgattcatctcgcgattgatcgagctcgagcggcggtgaggtgaggtggaggaggaggaggaggagatcgggtcgacgagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaaggtatatatacatggacgcactgggcgcgcgcctcgatctgctatagctagatcggtagctgcttgcaacgtagctagctagggtttcttgcgcgcgcctgcgcctccagatctggagcgcacgatggttttgtgaacttcttggtggcgattttgcggggatctggggctgcacatggtggatctgcgagtgtgctcgtgttttggtgagttttgggagggtttgggagaaggaagttggtggaattctgtgggaataattagggtttttgttcgttcgatcgggtgctagctagcgtaatagggagtggtgaaatacgtagatctgagggtttctgatcccgtggtagtagtggttttgagatggcgcgcttaatggttttgagtttggtttaattgcgattaatttatgtgcatgcatgggatgggacattcaggatttaagcctggatcagcaagtcgatttttacggagaaaattaatcgttggaagcttcgaatcttaattttatcgatctcctaatggagggtatgcgagtttcgaattcccttgggatctgtttttttcctcaatttttagttttttgaggggcaattttttttagggtatatatgattttttttttttgggggggggggggtgtgtgaagggatcatgcatatcattagccatgtaccggatgtgtgtctaaacaaacgttcactgcatgaattccacggtttggaggcagcataccttacaagatttgggggtttcacttaagattttgtctctttgtttttttaagggatggccgcgggggagtattgtttttcaagtgagttatggttgcatcattaaaggcaacatcaataaatataaagtctgtttctcctgagataagtatatgaaaaatcatatactactatatatataattgtctttcagaaacacagagcgtctgattggctaggcataattcacaagccgcatataagctagttgaattgattttgaattagaaaacattttttttcggggggaagaaaacatttggtattgtgtttagagataaacaattagttagggtagataagtcaggcattcatgagcttcatttcatatttgaatcatacattttccaaactttagaaggttaaattttcttgctcattgtattgcactgatcattttaataatatcttctatagtgaatattacatcattatatattttagataatgattacattattatatgctccgttgcagaaaaaaccaacttttttgccaaacctggacatatataggctatgtccagatttatagctagaagttagggcctcatcttttaccctatgaattataagccaatatcaaattttgaatttcgaaacttgatttagaagttgatttttaatgttttgtcaatgtagattgtttttcagcattaacttttaattcgctaaagacacatatacaattttactcacaaattatattttggttgctaataagccgttatggcttataatcagccgtaagtatatggggactttagcattctttttctttttttatggagggagtacatgcttgccaatttttatagttatgtttaaatggtttccattatacctaagttactaaattaaaattaatacgcctataaaattctaacattaaatatattcacaaataagagtacatgatttcattgaccagggaattcaatttggatatggggtgagtgaaacatccctcctctgctcctcggaagaaatcctgcaagggagtacacaatattcctaggactcacttgagtatctgcagggtacagttagtgacagctttcgattgtcattcgattggtctcctcagctctcgtagctgagctgtcagtacagaagattggtcttcatcagatgtctcttctagttctagctagagctagttcagtggagtattttatgccgacaaattgatactcaacgtgtactgtagatccttttcagaaatctgaattcacgacttgtttaaacaaaggctgtgtttggatccaaacttcagtccttttccattacatcaacctgtcatatacacacaacattttagtcatatcatctccaatttcaaccaaaatctaaactttgcgttgaactaaacacagccaaaaggtcactaaattgacgcggtagaggggggggggtgagcattatagctgtagtagtagtctgcgtgaagttatgccatttcattgtgtgtcgtctgaacttgatatctctctttaaagagtgtactccattttctttacaaaaagtggcctctaggttgatatcatggacatatataaaattataaatcaacttgaaactaccgatgcaagaattaagataaaacgttattgtttcttagaaattgtctccaattatgcaagcaccttcatccgtgtcatggagctaatgttcatgttttgtgggaaacaagatttttcatctactaattaatcgatgtggtccccggaaaagaatgtgccctagattgttagtatttagttatgggcgaactatatatgttcctttatttcgtttttccataaacatagccatttgtgtttttgaaacttgcagcttgaccaccatgg

SEQ ID NO: 21 - DNA, 108 bp, Oryza sativa
  misc_feature (1)..(111): OsMADS8 5'-untranslated leader sequence - native
gctttcccctctcttccgcttcgcgagattggttgattcatctcgcgattgatcgagctcgagcggcggtgaggtgaggtggaggaggaggaggaggaggagatcggg

SEQ ID NO: 22 - DNA, 300 bp, Oryza sativa
  misc_feature (1)..(304): OsMADS8 5'-untranslated leader sequence - engineered
  misc_feature (105)..(110): Engineered sequence
  misc_feature (292)..(292): Mutagenized base pair
  misc_feature (299)..(300): Engineered sequence
gctttcccctctctttcgcttcgcgagattggttgattcatctcgcgattgatcgagctcgagcggcggtgaggtgaggtggaggaggaggaggaggagatcgggtcgacgagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcttgaccacc

SEQ ID NO: 23 - DNA, 2034 bp, Oryza sativa
  misc_feature (1)..(2034): OsMADS8 3'-regulatory sequence
  misc_feature (1)..(324): 3'-untranslated sequence
  misc_feature (325)..(2034): 3'-nontranscribed sequence
actcctgaaggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattaccatgctcatgtgcattctaggttctttatatataggagtattaggttaactgattagttgttgtacatcattgtctaaaaaaatagctgtcgttgtacataaattgagcatgctggtctgcatgaaaattaaggaaaagaaacatgcaagtagcccaggtagttgggctgtcaagcagtcgtacttgtccgagtcgcagatagttagttgacccgaaactgtgattgcgaacgtacgagcgaaaatgtagatgcaggcatttcaacttgagtgatttgctttttattcatatatatggttcattttttttaaagatggcttcgactggatctcgtcttcgttaagcatgcgtccaggaccaggagtacatgcattttgcattcagccctaaccaatactttttaccaattaaagagcagagcaggcacgacacgcatagacaacggacatggatcttcgcagtactacatttgcagtagcagtggctgataggtgaacccgatcctacatgtcagtggctgctactgtagacaatctccactgatagacaacgggtacaactcgtagtattaattcaaacgccaaatgcattaatggtagtttgcttattagtactagtttgcataacgaagcgtgtatatatatttatacttcctccgttttatgttttaatttggacttgtcgttccagaaaatcgtacgaagtcatagcaaattacattgcaattcttcttaattacatattaatcatgttttcaaagtaagaattagaattccttataagagactactactagcatggttgtgttagagaaaggtaagaagaaaaaagcatttaaaaagtgatttggaatatgagaatgacaagtgttttggcataacttttaaatggtagaacgacaagtaatttaaaacatacaaagtactagtcccttcatttcatattataattcgcttcgactttttctaagtcaaacattgttaaatttgactaggttttatagaagaaaagtaacattttaaacgtcaaattagtttcattaaatctagcatttgaatatattttgataatatgtttgttttgtggtaaaaatactattatatttttctacaaatctagtcaaacgtaaaaaaaaagtttgactaggaaaaaagtcaaaacgatttataatataaaacataagagcacccgcaatagtaaagtaaggtgctctctgtaaaacatgtacatctcagcaatagactagattaatagtaaaccaccttaatagtatgtctacttgggtatctatagctctctaatatattgcctcgtttttctctatagactatcttcacattagtagatagctttgctctcttttttcatctcttccaagtaggaaaatatgctgacatggatctcttgtagagagtttatagataaccattgtgggtgccctaagtagtactatcttttcttcctgtccaaaaaatataaagcacttttgagcttctatacgtagatttaaatgagaaatggctatatttgattgagataagtgagtaggtaaacgctctatttaagataaattgtaaagttaatatattttgacggaggggaagtagcatttatgaaaccctagtagagctacgcttcgttgaccacactactcgaaataaacatgatattttgtcatgatcgatgact

SEQ ID NO: 24 - DNA, 2051 bp, Oryza sativa
  misc_feature (1)..(2051): OsMADS8 3'-regulatory sequence engineered
  misc_feature (1)..(8): Engineered sequence
  misc_feature (1)..(323): 3'-untranslated sequence
  misc_feature (324)..(2051): 3'-nontranscribed sequence
  misc_feature (2042)..(2047): Engineered sequence
gcggccgcaggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattaccatgctcatgtgcattctaggttctttatatataggagtattaggttaactgattagttgttgtacatcattgtctaaaaaaatagctgtcgttgtacataaattgagcatgctggtctgcatgaaaattaaggaaaagaaacatgcaagtagcccaggtagttgggctgtcaagcagtcgtacttgtccgagtcgcagatagttagttgacccgaaactgtgattgcgaacgtacgagcgaaaatgtagatgcaggcatttcaacttgagtgatttgctttttattcatatatatggttcattttttttaaagatggcttcgactggatctcgtcttcgttaagcatgcgtccaggaccaggagtacatgcattttgcattcagccctaaccaatactttttaccaattaaagagcagagcaggcacgacacgcatagacaacggacatggatcttcgcagtactacatttgcagtagcagtggctgataggtgaacccgatcctacatgtcagtggctgctactgtagacaatctccactgatagacaacgggtacaactcgtagtattaattcaaacgccaaatgcattaatggtagtttgcttattagtactagtttgcataacgaagcgtgtatatatatttatacttcctccgttttatgttttaatttggacttgtcgttccagaaaatcgtacgaagtcatagcaaattacattgcaattcttcttaattacatattaatcatgttttcaaagtaagaattagaattccttataagagactactactagcatggttgtgttagagaaaggtaagaagaaaaaagcatttaaaaagtgatttggaatatgagaatgacaagtgttttggcataacttttaaatggtagaacgacaagtaatttaaaacatacaaagtactagtcccttcatttcatattataattcgcttcgactttttctaagtcaaacattgttaaatttgactaggttttatagaagaaaagtaacattttaaacgtcaaattagtttcattaaatctagcatttgaatatattttgataatatgtttgttttgtggtaaaaatactattatatttttctacaaatctagtcaaacgtaaaaaaaaagtttgactaggaaaaaagtcaaaacgatttataatataaaacataagagcacccgcaatagtaaagtaaggtgctctctgtaaaacatgtacatctcagcaatagactagattaatagtaaaccaccttaatagtatgtctacttgggtatctatagctctctaatatattgcctcgtttttctctatagactatcttcacattagtagatagctttgctctcttttttcatctcttccaagtaggaaaatatgctgacatggatctcttgtagagagtttatagataaccattgtgggtgccctaagtagtactatcttttcttcctgtccaaaaaatataaagcacttttgagcttctatacgtagatttaaatgagaaatggctatatttgattgagataagtgagtaggtaaacgctctatttaagataaattgtaaagttaatatattttgacggaggggaagtagcatttatgaaaccctagtagagctacgcttcgttgaccacactactcgaaataaacatgatattttgtcatgatcgatgactcggtccgcccgggacgt

SEQ ID NO: 25 - DNA, 1193 bp, Oryza sativa
  CDS (60)..(872): OsMADS13
gaagaagctagtttcctgcggccgacctcttgcttctcactttttgagagcaagaagacatggggaggggcaggattgagatcaagaggatcgagaacacgacaagccgccaggtgaccttctgcaagcgccgcaacgggcttctcaagaaggcgtatgagctctccgtcctctgcgatgccgaggtggctctcatcgtcttctccagccgtggccgcctctacgagtactccaacaacaacaatgtgaaggctacaattgacaggtacaagaaggcgcatgcttgtggctcaacttctggtgcacctctcatagaggtcaatgctcagcaatactaccagcaggagtctgccaaactgcgccaccagattcagatgctgcaaaacaccaacaagcacctggttggcgataatgtgagcaacctgtcactgaaggagctgaagcaacttgaaagccgcctggagaaaggcattgcaaagatcagagccaggaagaatgaactgctggcttcagagatcaattacatggccaaaagggagattgagcttcagaacgacaacatggacctcagaaccaagattgctgaggaggagcagcagctgcagcaggtgacggtggcccggtcggccgccatggagctgcaggctgcggcggcggcgcagcagcagcagcagaatccgttcgcggtggcggcggcgcagttggacatgaagtgcttcttcccgttgaacctgttcgaggcggcggcgcaggtgcaggccgtggcggcgcagcgccagcagatcatccccaccgagctcaacctcggctaccaccaccacctcgccattcccggcgccaccgccgccgacgcgccgcctcctcacttctgaacctcatgaacttcattttgcaccggcctgctgccatggatatgatgatcagctcatcttctatatcttatgctgttatgcagacagacactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatattgactaaa

SEQ ID NO: 26 - protein, 270 aa, Oryza sativa
MGRGRIEIKRIENTTSRQVTFCKRRNGLLKKAYELSVLCDAEVALIVFSSRGRLYEYSNNNNVKATIDRYKKAHACGSTSGAPLIEVNAQQYYQQESAKLRHQIQMLQNTNKHLVGDNVSNLSLKELKQLESRLEKGIAKIRARKNELLASEINYMAKREIELQNDNMDLRTKIAEEEQQLQQVTVARSAAMELQAAAAAQQQQQNPFAVAAAQLDMKCFFPLNLFEAAAQVQAVAAQRQQIIPTELNLGYHHHLAIPGATAADAPPPHF

SEQ ID NO: 27 - DNA, 1901 bp, Oryza sativa
  misc_feature (1)..(1900): OsMADS13 5'-regulatory sequence
  misc_feature (1)..(931): 5'-nontranscribed sequence
  misc_feature (932)..(973): exon
  misc_feature (973)..(1881): Intron
  misc_feature (1882)..(1900): Exon
ttccaaaattaagcacacacatttgcaagaactagctaggcatgcatatatgataattaaccggcaagttgacttcagttattctgcagatgtactaaacacataacaagggatgatcagttgcttatttttttcataacttgctaggttgcttataactccagccttctggacatcgaccaatctctaaacatactttagcagtgcctacaaagtacaaacaactaaatacctctctgcagatcagtgtttctaggcacaaattacacaagatagaaaaaaggagaggttataaattcttgcttaaagaatatacatgtaaagatgtctaaatagctataaatgggtaagcaagatagcaaagaaggccagtggcctttgcagctaagctagctagctagcccttcttcctctctttcctgctttccctttgccttctcctattaatcctctgcacctcacacagcagcagaaaacccaccaactggagctctcctttcctactccaagaaacgaaggtagagaaagaaagatcagatcagcttcaggaccaattttagctaggttatatatctctttgcgtgctaatgtgttttagttatctgggtgtgtgtagagttctttgttaaggcactgattcagctgcagtttagattcaagtttgtatgttctctctttgaggaaaagaaacccttttcctgtgcttcgagttcttgcaaagagaaactgtgatgcttggcttccagtttgatgcttctttgttcagattggaaattcttcctagcttctttctctatttatgtagcaaggattctttccggcccagtgatcctggtttcttttggaaggtttcagttttttcgttctttcttgaaatttctcttcttgccttaggcagatctttgatcttgtgaggagacaggagaaaaggaagaagctagtttcctgcggccgacctcttgcttctcactttgtgatgagttttctttggtcaattcttagctagatatgttaagatagttagttaagcaaatcgaaattgctagcttttccatgctttcttaaacatgattcttcagatttggttggttcttttttttcctttttgtggagacgtgctgttcttgcatcttatccttcttgattcatctacccatctggttctttgagctttctttttcgcttcttcccttcattatttcgagcaatctctgcacatctgaaagttttgtttcttgagactacttttgctagatcttgtttactcgatcactctatacttgcatctaggctcctttctaaataggcgatgattgagctttgcttatgtcaaatgatgggatagatattgtccccagtctccaaatttgatccatatccgccaagtctttcatcatctttttctttcttttttatgagcaaaaatcatctttttctttcaaagttcagcttttttctcttgttttacccctctttagctatagctggtttcttattccttttggatttacatgtataaaacatgcttgaatttgttagatcgatcactttatacacatactatgtgaatcacgatctcagatctctcagtatagttgaattcattaatttcttagatcgatcagcgtgtgatgtagtactgtaaatcactactagatctttcatcagtctcttttctgcatctatcaatttctcatgcaagttttagttgtttctttaatccggtctctctctcttttttaatcagctgagagtttgtgctgttctttaatcattaccagatctttcatcagtactctctcttctgcatctatcaaacttctcatgcaatgtttttgctgttctttgatctgatctctggtctccttttttgttgatcagttgagagcaagaagccatgg

SEQ ID NO: 28 - DNA, 1913 bp, Oryza sativa
  misc_feature (1)..(1913): OsMADS13 5'-regulatory sequence engineered
  misc_feature (1)..(12): Engineered sequence
  misc_feature (1)..(942): 5'-non-transcribed sequence
  misc_feature (943)..(985): Exon
  misc_feature (986)..(1893): Intron
  misc_feature (1894)..(1913): Exon
  misc_feature (1908)..(1913): Engineered sequence
gcatgcggaccgttccaaaattaagcacacacatttgcaagaactagctaggcatgcatatatgataattaaccggcaagttgacttcagttattctgcagatgtactaaacacataacaagggatgatcagttgcttatttttttcataacttgctaggttgcttataactccagccttctggacatcgaccaatctctaaacatactttagcagtgcctacaaagtacaaacaactaaatacctctctgcagatcagtgtttctaggcacaaattacacaagatagaaaaaaggagaggttataaattcttgcttaaagaatatacatgtaaagatgtctaaatagctataaatgggtaagcaagatagcaaagaaggccagtggcctttgcagctaagctagctagctagcccttcttcctctctttcctgctttccctttgccttctcctattaatcctctgcacctcacacagcagcagaaaacccaccaactggagctctcctttcctactccaagaaacgaaggtagagaaagaaagatcagatcagcttcaggaccaattttagctaggttatatatctctttgcgtgctaatgtgttttagttatctgggtgtgtgtagagttctttgttaaggcactgattcagctgcagtttagattcaagtttgtatgttctctctttgaggaaaagaaacccttttcctgtgcttcgagttcttgcaaagagaaactgtgatgcttggcttccagtttgatgcttctttgttcagattggaaattcttcctagcttctttctctatttatgtagcaaggattctttccggcccagtgatcctggtttcttttggaaggtttcagttttttcgttctttcttgaaatttctcttcttgccttaggcagatctttgatcttgtgaggagacaggagaaaaggaagaagctagtttcctgcggccgacctcttgcttctcactttgtgatgagttttctttggtcaattcttagctagatatgttaagatagttagttaagcaaatcgaaattgctagcttttccatgctttcttaaacatgattcttcagatttggttggttcttttttttcctttttgtggagacgtgctgttcttgcatcttatccttcttgattcatctacccatctggttctttgagctttctttttcgcttcttcccttcattatttcgagcaatctctgcacatctgaaagttttgtttcttgagactacttttgctagatcttgtttactcgatcactctatacttgcatctaggctcctttctaaataggcgatgattgagctttgcttatgtcaaatgatgggatagatattgtccccagtctccaaatttgatccatatccgccaagtctttcatcatctttttctttcttttttatgagcaaaaatcatctttttctttcaaagttcagcttttttctcttgttttacccctctttagctatagctggtttcttattccttttggatttacatgtataaaacatgcttgaatttgttagatcgatcactttatacacatactatgtgaatcacgatctcagatctctcagtatagttgaattcattaatttcttagatcgatcagcgtgtgatgtagtactgtaaatcactactagatctttcatcagtctcttttctgcatctatcaatttctcatgcaagttttagttgtttctttaatccggtctctctctcttttttaatcagctgagagtttgtgctgttctttaatcattaccagatctttcatcagtactctctcttctgcatctatcaaacttctcatgcaatgtttttgctgttctttgatctgatctctggtctccttttttgttgatcagttgagagcaagaagccatgg

SEQ ID NO: 29 - DNA, 1186 bp, Oryza sativa
  misc_feature (1)..(1186): OsMADS13 3'-regulatory sequence
  misc_feature (1)..(335): 3'-untranslated sequence
  misc_feature (336)..(1186): 3'-nontranscribed sequence
ccgcctcctcacttctgaacctcatgaacttcattctgcaccggcctgctgccatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgcatgcatgcatgcttaattgtgtcacctttggggattcattttgtacatatgtgcaccattttgtgtgtacaatgcaggtttatatgacttttttcgcaattacacgatggcccatgcacataaccaccatgcacactgcacgtacatccacaagtgtgcccctttaacacaaggcaatacaccaaataaattgtaatgtgccactaaacttttttgaaagtgtaaccgcgcgtatgcttccgtggcttatatatgactctggtggctgacttctagggcatgtcgacctgagcatcttcgtgtgggtttcgactctctaattctcctggtctctggcagttgtggaaggggcgaaactccagggtttttgattactctctttcctcactctcaagggttctgaaagtcatcctacaggaagaccgtttgtggtcttctgctggcgtcgctgtttttaggggtttattaggagtgtagtggagcttcgccaccaccctccatctatttaggagcaacatttttttggtagttttttactttagcagtctttttgtttctttctttgttcccttatccacatgcaatggtcgtctgactggttacgttgtgtaacaaaaactctgcttttttctaatatactgacgtgcaatcctttggtgcgttcgcgaaaagaaagggggatcaattgcaagtattttgtgggaattaaacttttcttgtgaaattattgtaaaattccagcattctaaatgagctctaatgtgtgataatttgcattctctatatatattgaataattcttttgttgactagttgggtgcccgtgcgttgc

SEQ ID NO: 30 - DNA, 1161 bp, Oryza sativa
  misc_feature (1)..(1161): OsMADS13 3'-regulatory sequence engineered
  misc_feature (1)..(8): Engineered sequence
  misc_feature (1)..(294): 3'-untranslated sequence
  misc_feature (295)..(1161): 3'-nontranscribed sequence
  misc_feature (1145)..(1161): Engineered sequence
gcggccgctgacatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgcatgcatgcatgcttaattgtgtcacctttggggattcattttgtacatatgtgcaccattttgtgtgtacaatgcaggtttatatgacttttttcgcaattacacgatggcccatgcacataaccaccatgcacactgcacgtacatccacaagtgtgcccctttaacacaaggcaatacaccaaataaattgtaatgtgccactaaacttttttgaaagtgtaaccgcgcgtatgcttccgtggcttatatatgactctggtggctgacttctagggcatgtcgacctgagcatcttcgtgtgggtttcgactctctaattctcctggtctctggcagttgtggaaggggcgaaactccagggtttttgattactctctttcctcactctcaagggttctgaaagtcatcctacaggaagaccgtttgtggtcttctgctggcgtcgctgtttttaggggtttattaggagtgtagtggagcttcgccaccaccctccatctatttaggagcaacatttttttggtagttttttactttagcagtctttttgtttctttctttgttcccttatccacatgcaatggtcgtctgactggttacgttgtgtaacaaaaactctgcttttttctaatatactgacgtgcaatcctttggtgcgttcgcgaaaagaaagggggatcaattgcaagtattttgtgggaattaaacttttcttgtgaaattattgtaaaattccagcattctaaatgagctctaatgtgtgataatttgcattctctatatatattgaataattcttttgttgactagttgggtgcccgtgcgttgcggaccgatcgatacgt

SEQ ID NO: 31 - DNA, 4617 bp, Oryza sativa
  misc_feature (1)..(4617): AB00322 5' regulatory sequence
  misc_feature (1)..(2183): 5' nontranscribed sequence
  misc_feature (2184)..(2457): 5' UTR
  misc_feature (2458)..(4604): Intron
  misc_feature (4605)..(4617): Exon
cgttgcccagcgaggagcatgcgtaaaatccgcccaagctggtgcttgttgttgccgcgacccatgacggcatccgattctagtattacatgcttgccggcgttatcgagcacacaacgatgttccccgtcgacaccctcaagatgaacatgcaggtcggtgccccaccctgttactcggtcctgtcattggaggccgccttgtctggctaagtagtggacacatgttagccaacatgaacaatagatgacaatatggatgacgccgtgtgcattggtttgagtccaagcatggaaggtggtgtgatgtgaaagttaatttgtcatccctcggtgcaaagcgaaggtatatatgaaaccgggtgtaaagggaaaacaaaataaatctacccgatgttaagtgcaatttactctttatttatttttacttatttgattatgctgtaaccgagttggatggcaaaccacgtatggtgtgatagatttacttccaccattatcctcctttttatctcctacatatgtgtttacagttcgcttatagtatgctgttgtatatgctctcactgcaaactataattaattaacctgaaaaatataacaaaggtcctttcagattgctgccgagtctaagggctcattcggaatgtaggattgaaaaaaatataggaataggaaaaatataggaataggataggaatgcaagtgtaaaacagatgatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccggccgcgccgcccgaagccaccaccctttccttttccggaagcctccccaatcctccgccattccccgcatagcgccccatgcccctaccgaccatagcctcccaatcccccatcgcctagctgcttcgccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccaggtatgctgttctactcccacgcctggatatctctcgactccgcttcgtctcccgcgtttcgatagatctagctaggcgcgtttcctcccccggtctccctttgacttcgatgtctaagatccatccgcctgggctagggtttaacacgggatattttaactagtaacacggatctcaccatttccacccgttcagaaaaatcaatacagttttagaacgactcgtggttactttcgccccctttagatgtaggggatttactgtagtgtatgtagtctgcacctgtacttttgcagattattttcgaggtgttctttttttggtgcatgagtagcccatcttatttggccattcctactggaaatatcgtacgacaactcctgttatttgctgtttatgtgcgcgtggagttaatcgatgtgtgtgtcgcagtagtgctgtgttggtgataaagctagctagctctgctgatagcctacggtcgtacgtgtgattttatgtgctgatgcgtcgcgttttaccctctgatcaatggggggtctcgtgttttgtgcacggaaaacctcgcttcctgttgttgttttcttttgcaatgtgttaaatcattgcagaactgttgtttgatgagaaatatcctgttgttgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatggtacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatccttcttctacattggatgccataagattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttggacagtatgaatgaaatc

SEQ ID NO: 32 - DNA, 934 bp, Oryza sativa
  misc_feature (1)..(934): AB003322 3' regulatory sequence
  misc_feature (1)..(323): 3' UTR
  misc_feature (324)..(934): 3' nontranscribed sequence
taactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaagtatgatcttgcgctatcttttgcgctatcttgcattcttgcgtaatatatatacattgtcgctgtcgttagatttcagttcttagctagcagccactagttggtgttaatagcttttccttttcctttcccttttcttttcatgatttacctgtcacgctatttcgcgggctgcaatttgttgcttgagatatgctctgcatggaagaacactatgcagatgcgctccagcattgattttcattatgggatactaacggggtatatgttgctgtgtgctacagatgtacagcgacgcagcagaaaaggtgacagctgcagtatatgtactgatctttccatttaatattaaaaaatctatatctttccgtttgctcgcatatccttctattttggattaagagcctcaccgtttgacttatctgcggaataagctaaataatatgtgttcttagcgatgtaaaagcaaaggctaaaaaaattaatgtcgatgaaaaaaccttaaaatcggcttcaaatttaaggttaaaaatttagattttggttaataagtataagcataagtgaaaagataagaccgtaaatggttggatttcagttgccagatttattc

SEQ ID NO: 33 - DNA, 4781 bp, Oryza sativa
  misc_feature (1)..(4781): AB003324 5'-regulatory sequence
  misc_feature (1)..(1988): 5'-nontranscribed sequence
  misc_feature (1989)..(2432): 5'-UTR
  misc_feature (2433)..(2763): intron
  misc_feature (2764)..(4781): partial exon
tctaaatagggcccaacatactcaaggctttggaatattactcacacacacacacacacaaattcatgtgggtcaaatagcttgtcctttagaattttggaatttcccccattctccaactagaatatccaatgaaattattgcgtttaaaagaaagagttgggcggtgacgatatggggttttatcaactttcaaaatgaacacctatgaaatttctacttaacctcaacttcaatatgagaaatgtaaagtaaaaggaaaaattttctacaaaacatctaaaaaacatgatctttgctggtggacaccgttaaaaatgtagcttttgtcttagggcactaaaaaacgtgataatttgctggagaacatcacggcctttaaaatgtaaaatccacttaattgagaagagatgaggcatatgaaatgtttattttgccctcctcttcttcctcgccactcatgtcatcgcctcgctgcctgctaataggggtttgagtgagagagcacaaagattgagaggcggggatatgatcagttcgaactgagacatactccttcgttcacatatgcgggataggggcctcctaaaatatttttctatcaaataggatgaaaacaataaaataatcgatgtttatgttcttcagcaaattaccatatttttatagtgttctcggaaaatccacgttttgatttagatatactgtagcaaatttgccaaattaaaactaaccggtttaattaattttaggttttagcaagtactgtacgctcttcaagttgtggcaactactttgattgcagctacagtacaccccccgatcgagagcgagaccgagggttacgtggtgggcccagcgcggcagccacactgtaggagtgacagtgctaggctacagctactgtgctgggcgtagtagttgttccgctcactgtgcagatgagctcatgcgctcatcgatccccctcctctcctcctcctcctctctgtcctctgccatcccccccacccgtcacgtgaggcgacgccgccgacctgatggctcgacatgccccccgtcccggtcgacgcgacgtgcactgtgaccggccggaagaacgccccccctgccagccggcgacacgcacgcgtccggccatggctgcctagctagcgtatcgctcccccagctaccggcctcgccgtgtggcccggcgccccggcgtgcgtacgcgtcgggtacgtaggaaacacggcggcagcgtcgaggcgaggacggggaagcggctggaccggcgggccgggggaagagaggcagccatcctgtactctcctacgtacagccaccttacctgttgcgtcaacgagagcttgggcgttgctcgctacagccgctggctagcttagcttatagctagtctccgcttagcctgtgggcataaaagcacccggcaccagcgtccgctcgacacgtcgcgattccgcctctgtgcgcgctgctgcccgggccgcaccgtgtgatacgtacacaacctcgggttcgacgcccccgccggcccggtcgcttccctcgcctcgctgttaacgtcgctgttacaagcttgcgaattgcgattgtgcgagcgctcgcggcggtattaatttttgctatacctggggcgatggaaacgtaacgtactactactacgtgacctagggtgagagacgagacgagacgagaatatgagatgagatccaaattcaatctgcctctctaccccacgaaagaaaagattcttctcttcgtcgacgacccggcctctcgctctcgttgcctttctttcgcgctcagtctctctcggccaattaagctgtagatcggccaccaccaccaccaccaccaccaccatccacagggcgctgcaagctgggccaggcctctctctatctctctctcttgagaggagagattaagtagggcatagagagaaaaaagctactcctaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgagatggggcgaggcaaggtggtgcttcagcggatcgagaacaagatcagccggcaggtgacgttcgccaagcggcggaacggcctgctcaagaaggcctacgagctctccatcctctgcgacgccgaggtcgccctcgtcctcttctcccacgccggccgcctctaccagttctcctcctcatccaagtaaacccactgcccctctcactcatctcagcttcctcctcttcccctaatcaaattctctcaacttgcttaacctgcactccccaaaccgcaatttgctccatctttgcgcgcacaatctgcaagaaatcacgaccgatctgaattttctcgcgcgtgtactgtatccgtcgtcgtccgtgcatgaacttatgggaggggccatgatttcgtacgtgttgttttttctacgcctgttcctttctttctgttctattgggcgaagctactgttcatgtaaaaaaggctacaaaagaacaaggcaaagaagacgaggttgtcctcggcaggagatccagacatgtacatatatgcgtatatataccgtgtgtgtatatatgtatgtgtgtcatagcaggcaagaaaaattaagaaaggggtttcatttgatgtaaatatcatggcgtgtacaaatgctagaatctgaattagcctaaaatttggaggatttaacttgatggagtttaaataatttacttggaagaatgccacttttagtactagctgttgatgagcaaaatttgctgaagaatgccgcttttgatcaaaatttgtcgtttacttatatattatcaaggatacttttgtgtgttaattataaacttgctgcaataaatatctcatgaacacaacacactagttaaactcaccaacatcgtcatgtgttaattcatctacggcttggaacttgcaagaactactttaacgtacaagctctgactttgtatatctgacagtaccaaaatactgttaccttatagctacgttggaaaagatcaactgtacaactactttcagctctataaaacaattcactgtaggcaaatgcaccgtccatatatatagacactctgtgaggtagaattgctaatttatagtatattattatattaacgtgtaattgacccatacaggataatcttcaaatttggggcagtttgcatgaaatgtggaactcacattagcaaaaattgcatattaaagaatacactgaccatgttaatatacatgctagtgagttatagtttgtatggggatgctaatatgttttggcctttttccccatatgaatgtatgctacattcttacaattaatatatacgttacaaagggaaatcaaatgacctagtagtttctattactgaattattgcacatttagtttttccaatcaatcactaaattgccataagggtccagtttttttgtctgtttcttgttggttctttgtcaagtatcatatatatatgtaccatatttttgtaggaatatgcattcgcgctagctaccgtatgatgatcacacaggtttcaacccttggttaacactgttaatttgttgttataaggggtatcatccatagagacagattactgtatttgaataagagatttctgtataataatgctatgccgttattggttctttatcaagtgccacagtaccttgtttttgtagtatatgtgttcactagctaccatgtgatgatcacacaaagtttcaccgttggtgaactgttaatttgtcatatgtgacatgcatcatccatagatacacgtttctcatattaataatttttaaatattgctaggaaaaaatggtgtcttattgggttataacacactagaatattgttttatttttatccttcatcctcagtgaaaaaggatgtacaattagtggcttggcacagactagggctgctttgttaattagatcaccttttatttttctcctaaaggtgaggggggggggggacgaaaacacttcggatggagcggcatacaaatttaaagctatattttccatatatttatttgcatttttcttgtttaatttggtataatcaattttctggtggcaccaaagcacctaagatggacttaggttgggttctttacttcttttagacactttctcaacttctattatctcggtttactttgtacgtttcccaaattgctaaacaatacgttttttataaaaatctataagaaagttgcttataaaaaaccatattaatctatttttaagtttttttaagctaatacttaattaatcgtgcgttactttgttttgtgtgcgagagggaacagttcccaaccctctccaatgaatgtaccctaaaggaggcttgattttttttttcctgaggaagaaaatgacaacgaaacattcacaaattgatcggaagacataattaacagctttattaatatactatttcttttaggggaaacatattttctgtatagtgtgctagttaaccatctatctctaattcatatttcagcatgcttaagacgcttga

SEQ ID NO: 34 - DNA, 4782 bp, Oryza sativa
  misc_feature (1)..(4782): AB003324 5'-regulatory sequence engineered
  misc_feature (1)..(1988): 5'-nontranscribed sequence
  misc_feature (1989)..(2432): 5'UTR
  misc_feature (2248)..(2250): Mutagenized start codon
  misc_feature (2433)..(4763): Intron
  misc_feature (4764)..(4782): Engineered sequence
tctaaatagggcccaacatactcaaggctttggaatattactcacacacacacacacacaaattcatgtgggtcaaatagcttgtcctttagaattttggaatttcccccattctccaactagaatatccaatgaaattattgcgtttaaaagaaagagttgggcggtgacgatatggggttttatcaactttcaaaatgaacacctatgaaatttctacttaacctcaacttcaatatgagaaatgtaaagtaaaaggaaaaattttctacaaaacatctaaaaaacatgatctttgctggtggacaccgttaaaaatgtagcttttgtcttagggcactaaaaaacgtgataatttgctggagaacatcacggcctttaaaatgtaaaatccacttaattgagaagagatgaggcatatgaaatgtttattttgccctcctcttcttcctcgccactcatgtcatcgcctcgctgcctgctaataggggtttgagtgagagagcacaaagattgagaggcggggatatgatcagttcgaactgagacatactccttcgttcacatatgcgggataggggcctcctaaaatatttttctatcaaataggatgaaaacaataaaataatcgatgtttatgttcttcagcaaattaccatatttttatagtgttctcggaaaatccacgttttgatttagatatactgtagcaaatttgccaaattaaaactaaccggtttaattaattttaggttttagcaagtactgtacgctcttcaagttgtggcaactactttgattgcagctacagtacaccccccgatcgagagcgagaccgagggttacgtggtgggcccagcgcggcagccacactgtaggagtgacagtgctaggctacagctactgtgctgggcgtagtagttgttccgctcactgtgcagatgaggtcatgcgctcatcgatccccctcctctcctcctcctcctctctgtcctctgccatcccccccacccgtcacgtgaggcgacgccgccgacctgatggctcgacatgccccccgtcccggtcgacgcgacgtgcactgtgaccggccggaagaacgccccccctgccagccggcgacacgcacgcgtccggccatcgctgcctagctagcgtatcgctcccccagctaccggcctcgccgtgtggcccggcgccccggcgtgcgtacgcgtcgggtacgtaggaaacacggcggcagcgtcgaggcgaggacggggaagcggctggaccggcgggccgggggaagagaggcagccatcctgtactctcctacgtacagccaccttacctgttgcgtcaacgagagcttgggcgttgctcgctacagccgctggctagcttagcttatagctagtctccgcttagcctgtgggcataaaagcacccggcaccagcgtccgctcgacacgtcgcgattccgcctctgtgcgcgctgctgcccgggccgcaccgtgtgatacgtacacaacctcgggttcgacgcccccgccggcccggtcgcttccctcgcctcgctgttaacgtcgctgttacaagcttgcgaattgcgattgtgcgagcgctcgcggcggtattaatttttgctatacctggggcgatggaaacgtaacgtactactactacgtgacctagggtgagagacgagacgagacgagaatatgagatgagatccaaattcaatctgcctctctaccccacgaaagaaaagattcttctcttcgtcgacgacccggcctctcgctctcgttgcctttctttcgcgctcagtctctctcggccaattaagctgtagatcggccaccaccaccaccaccaccaccaccatccacagggcgctgcaagctgggccaggcctctctctatctctctctcttgagaggagagattaagtagggcatagagagaaaaaagctactcctaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgagatcgggcgaggcaaggtggtgcttcagcggatcgagaacaagatcagccggcaggtgacgttcgccaagcggcggaacggcctgctcaagaaggcctacgagctgtccatcctctgcgacgccgaggtcgccctcgtcctcttctcccacgccggccgcctctaccagttctcctcctcatccaagtaaacccactgcccctctcactcatctcagcttcctcctcttcccctaatcaaattctctcaacttgcttaacctgcactccccaaaccgcaatttgctccatctttgcgcgcacaatctgcaagaaatcacgaccgatctgaattttctcgcgcgtgtactgtatccgtcgtcgtccgtgcatgaacttatgggaggggccatgatttcgtacgtgttgttttttctacgcctgttcctttctttctgttctattgggcgaagctactgttcatgtaaaaaaggctacaaaagaacaaggcaaagaagacgaggttgtcctcggcaggagatccagacatgtacatatatgcgtatatataccgtgtgtgtatatatgtatgtgtgtcatagcaggcaagaaaaattaagaaaggggtttcatttgatgtaaatatcatggcgtgtacaaatgctagaatctgaattagcctaaaatttggaggatttaacttgatggagtttaaataatttacttggaagaatgccacttttagtactagctgttgatgagcaaaatttgctgaagaatgccgcttttgatcaaaatttgtcgtttacttatatattatcaaggatacttttgtgtgttaattataaacttgctgcaataaatatctcatgaacacaacacactagttaaactcaccaacatcgtcatgtgttaattcatctacggcttggaacttgcaagaactactttaacgtacaagctctgactttgtatatctgacagtaccaaaatactgttaccttatagctacgttggaaaagatcaactgtacaactactttcagctctataaaacaattcactgtaggcaaatgcaccgtccatatatatagacactctgtgaggtagaattgctaatttatagtatattattatattaacgtgtaattgacccatacaggataatcttcaaatttggggcagtttgcatgaaatgtggaactcacattagcaaaaattgcatattaaagaatacactgaccatgttaatatacatgctagtgagttatagtttgtatggggatgctaatatgttttggcctttttccccatatgaatgtatgctacattcttacaattaatatatacgttacaaagggaaatcaaatgacctagtagtttctattactgaattattgcacatttagtttttccaatcaatcactaaattgccataagggtccagtttttttgtctgtttcttgttggttctttgtcaagtatcatatatatatgtaccatatttttgtaggaatatgcattcgcgctagctaccgtatgatgatcacacaggtttcaacccttggttaacactgttaatttgttgttataaggggtatcatccatagagacagattactgtatttgaataagagatttctgtataataatgctatgccgttattggttctttatcaagtgccacagtaccttgtttttgtagtatatgtgttcactagctaccatgtgatgatcacacaaagtttcaccgttggtgaactgttaatttgtcatatgtgacatgcatcatccatagatacacgtttctcatattaataatttttaaatattgctaggaaaaaatggtgtcttattgggttataacacactagaatattgttttatttttatccttcatcctcagtgaaaaaggatgtacaattagtggcttggcacagactagggctgctttgttaattagatcaccttttatttttctcctaaaggtgaggggggggggggacgaaaacacttcggatggagcggcatacaaatttaaagctatattttccatatatttatttgcatttttcttgtttaatttggtataatcaattttctggtggcaccaaagcacctaagatggacttaggttgggttctttacttcttttagacactttctcaacttctattatctcggtttactttgtacgtttcccaaattgctaaacaatacgttttttataaaaatctataagaaagttgcttataaaaaaccatattaatctatttttaagtttttttaagctaatacttaattaatcgtgcgttactttgttttgtgtgcgagagggaacagttcccaaccctctccaatgaatgtaccctaaaggaggcttgattttttttttcctgaggaagaaaatgacaacgaaacattcacaaattgatcggaagacataattaacagctttattaatatactatttcttttaggggaaacatattttctgtatagtgtgctagttaaccatctatctctaattcatatttcagcatccttaagccaccatgg

SEQ ID NO: 35 - DNA, 1403 bp, Oryza sativa
  misc_feature (1)..(1403): AB003324 3'-regulatory sequence
  misc_feature (1)..(233): 3'-untranslated sequence
  misc_feature (234)..(1403): 3'-nontranscribed sequence
tagctagctagctagctaccgtttcagcttcagttaatcagggtcaagtatcagctgagtttggccatatgtatggattctatatgttgcttcagaagttcctctctccttcctcttcaatttgttgctaattaagtgcttgccaaacttttctcagtgtaatgtactactactatgtatagttttgtcttgtatgaacagtttgtgagtactgtcactgcgagtaaggtgcgtgatatggtaccgtgaaaacaaaagcgggacaaccatcctttttgcgtttacatcatgtttgtgatatcaagtcgatatatccacgatgttgtagtgctcaacagttatagaccttacttttagaaatatcgcactccatttatcatatgtagctaccttaggccaaaaaaaaaaacttttttaaaaaagtgcgtaatattcgtataagagacaacataatttcaccccatcaataaaggtagctgtacataatattctaaatgaagcatgatcggtaggtaaagagatgcgtatagtcatgatgactagacaacactcacgtgcaaggtatgaaactagtggacattgttagtggcacggtcgaggtccatccaccgaccggctaaaatataaaaatgccacacgcactatcaccaccaaaagaaaagaaaatgaataagagaggggccgcgtggagccaggtggggcactagagtactactccctatgtttcaaaatataagcatttttatgatttaaaatttgtatcacaatataattctaaaacactaacatctatatatttttagccaatgagatgcttgggaagttaatacaagcaattcaaaattttaaaaataaccattgtttacaaaaacattttcatttacttaagaataaaaatccttatatttatggacggaagcgaagatgtattagacagagatggtcgtacatttggataggacaacgactttgtctgcccgtggcctcctcccaagcttcatctccaaattaatctactatgttgcgtagcacgaagctatggcctacccctgtcttattcatctcgcacatatcgatacaaaacaaaaagaccgaaacacccatattttatcaaatctcaatgcaattatttctcactttatatactctcagtataattattttgtactttcataaacttcgatgcaatgatcactaaaaataaaattaattttgggataaatataatgagccaaaaataaacttattacgggacggatggagtactatgtggagagggatgtgtggcctaactgctctcttgttgtaatctcacttaggaatatgcttctcctgatattggcttgttgtttttctagctttgggcaggaattattgacgaatttaattgtggtcgatctcca

SEQ ID NO: 36 - DNA, 1400 bp, Oryza sativa
  misc_feature (1)..(1400): AB003324 3'-regulatory sequence engineered
  misc_feature (1)..(230): 3'-untranslated sequence
  misc_feature (231)..(1400): 3'-nontranscribed sequence
ctagctagctagctaccgtttcagcttcagttaatcagggtcaagtatcagctgagtttggccatatgtatggattctatatgttgcttcagaagttcctctctccttcctcttcaatttgttgctaattaagtgcttgccaaacttttctcagtgtaatgtactactactatgtatagttttgtcttgtatgaacagtttgtgagtactgtcactgcgagtaaggtgcgtgatatggtaccgtgaaaacaaaagcgggacaaccatcctttttgcgtttacatcatgtttgtgatatcaagtcgatatatccacgatgttgtagtgctcaacagttatagaccttacttttagaaatatcgcactccatttatcatatgtagctaccttaggccaaaaaaaaaaacttttttaaaaaagtgcgtaatattcgtataagagacaacataatttcaccccatcaataaaggtagctgtacataatattctaaatgaagcatgatcggtaggtaaagagatgcgtatagtcatgatgactagacaacactcacgtgcaaggtatgaaactagtggacattgttagtggcacggtcgaggtccatccaccgaccggctaaaatataaaaatgccacacgcactatcaccaccaaaagaaaagaaaatgaataagagaggggccgcgtggagccaggtggggcactagagtactactccctatgtttcaaaatataagcatttttatgatttaaaatttgtatcacaatataattctaaaacactaacatctatatatttttagccaatgagatgcttgggaagttaatacaagcaattcaaaattttaaaaataaccattgtttacaaaaacattttcatttacttaagaataaaaatccttatatttatggacggaagcgaagatgtattagacagagatggtcgtacatttggataggacaacgactttgtctgcccgtggcctcctcccaagcttcatctccaaattaatctactatgttgcgtagcacgaagctatggcctacccctgtcttattcatctcgcacatatcgatacaaaacaaaaagaccgaaacacccatattttatcaaatctcaatgcaattatttctcactttatatactctcagtataattattttgtactttcataaacttcgatgcaatgatcactaaaaataaaattaattttgggataaatataatgagccaaaaataaacttattacgggacggatggagtactatgtggagagggatgtgtggcctaactgctctcttgttgtaatctcacttaggaatatgcttctcctgatattggcttgttgtttttctagctttgggcaggaattattgacgaatttaattgtggtcgatctcca

SEQ ID NO: 37 - DNA, 1702 bp, Oryza sativa
  misc_feature (1)..(1702): AB003328 5'-regulatory sequence
  misc_feature (1)..(1400): 5'-nontranscribed sequence
  misc_feature (1401)..(1519): 5'-UTR
  misc_feature (1520)..(1655): Intron
  misc_feature (1656)..(1702): Exon
aacaaaaccaataatctccaatgcccaattgttcatcacaaaataataataaaaaacacctttgattttacaaaatatttaaatgcaaaaacgactttcacgtaggttccatgtgtcagtttaggggacttggtggtgggagtggcagactcaccatatccaccactcttttttttcttttaaagtagtatagatcttctctgaaagtccactaggagtcgatgttaagcttaatataacatcggcttttatctcatctcttgatccaaaaggaaataggagcacatgtgatttgaaatgtcacagtaaatcccagtgaaaaaagcctaaggaagtgagctatgctcatgctgcttttactactactccatccgtcccataatataagggattttgagtttttgcttgcaacgtttgaccactcgtcttattcaaaaatttttgaaattattatttattttatttgtgacttactttattatctacagtactttaagcacaacttttcgttttttatatttgcaaaaaaaatttaaataagacgagtggtcaaacgttgcaagcaaaaacttaaaatcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatgggggggggggggggggcggaagcggaaccaactttttcgccggatgggaaatttcggcctcgctttccttgtttgttcggcccggatgcattaccacttctgcccctgggtgcggtggccatgatgacgataaaaaacggaaacgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaagatg

SEQ ID NO: 38 - DNA, 1915 bp, Oryza sativa
  misc_feature (1)..(1915): AB003328 3'-regulatory sequence
  misc_feature (1)..(703): 3'-untranslated sequence
  misc_feature (704)..(1915): 3'-nontranscribed sequence
taagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcatacttgtactcctgcttgattgtggcttggtatttgatgtgatgttggagcaaacatatgctgaacatatctcagttgagattctctgcacaaggccggaacgggaggaagacgaaaggaggagttttaaagagggagggagtacattcaggtgacagatcgctttgacctgtacccctgttgtatatgacgcgctatgctggtattggtcgacgtttcgatctcttgaatgctacctgtggtcgacgtgtcgattgggcagtggaagccgaggagacttatggacccttatccccatcgcttctagtagtatccctcgattcggtgcgtgataacggtttttgcttgcaaagccgcgatgtgatttttccaactctggagtctgaagtagtagtagtatatttctctttacagcgagtatatatggaatttttttgagaattaatattatttttatggaaaatcgcaaaagtagtggccaaccggggaaaatcgcgaaagtaggtccctgtcgaacgggtgcaattcgataggacacctatcgaacaacgggcagtcgacaaacacctgtcgaacggctggcgttcgacacactcacctgtcgaacggagggagttcgaaagggcccaccaccggcgccgcgaggcctgtcgaaccgggggcgttcgacagcgctcacctgtcgaacggagggagttcgacagggcccaccacccggcgccgcgaggcctgtcgaaccgggggcgttcgacagggccctccaccgaccctgtcgaacaatcggcgtttgacaggccggtttaaaagccccgtccgcgagttcgatttgtttcgaggaccacatcgccagccgccgccgagagtcgccagttcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtacacgataaatttgtcataaatgccgtgtggccagtgaggggtcaacatggatggcagtggagagtagtggaggttgcgtcaactgggagttggaggaagtttgttagtaaagtaagggagaaaggctatagcccggcaat

SEQ ID NO: 39 - DNA, 1703 bp, Oryza sativa
  misc_feature (1)..(1703): AB003328 5'-regulatory sequence engineered
  misc_feature (1)..(1399): 5'-nontranscribed sequence
  misc_feature (1400)..(1519): 5'-UTR
  misc_feature (1520)..(1655): Intron
  misc_feature (1656)..(1703): partial exon engineered
aacaaaaccaataatctccaatgcccaattgttcatcacaaaataataataaaaaacacctttgattttacaaaatatttaaatgcaaaaacgactttcacgtaggttccatgtgtcagtttaggggacttggtggtgggagtggcagactcaccatatccaccactcttttttttcttttaaagtagtatagatcttctctgaaagtccactaggagtcgatgttaagcttaatataacatcggcttttatctcatctcttgatccaaaaggaaataggagcacatgtgatttgaaatgtcacagtaaatcccagtgaaaaaagcctaaggaagtgagctatgctcatgctgcttttactactactccatccgtcccataatataagggattttgagtttttgcttgcaacgtttgaccactcgtcttattcaaaaatttttgaaattattatttattttatttgtgacttactttattatctacagtactttaagcacaacttttcgttttttatatttgcaaaaaaaatttaaataagacgagtggtcaaacgttgcaagcaaaaacttaaaatcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatgggggggggggggggggcggaagcggaaccaactttttcgccggatgggaaatttcggcctcgctttccttgtttgttcggcccggatgcattaccacttctgcccctgggtgcggtggccatgatgacgataaaaaacggaaacgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatccaccatgg

SEQ ID NO: 40 - DNA, 1912 bp, Oryza sativa
  misc_feature (1)..(1912): AB003328 3'-regulatory sequence engineered
  misc_feature (1)..(700): 3'-untranslated sequence
  misc_feature (701)..(1912): 3'-nontranscribed sequence
gtaacaggccaggaataagctggatctctgcgttgagaaaggagatgatgctaggcatgcaatgacaccaaaccatcctaaaaacagaccacgctgtatattttacttacccgtattgtcgtccatgcatgcgaaatgctagacgcatatgcacccacccattcagcaccaccaggcagaaacccttcgatcggcagactccactacccatctaaatctaaatcgagagatctcaagtgcatacttgtactcctgcttgattgtggcttggtatttgatgtgatgttggagcaaacatatgctgaacatatctcagttgagattctctgcacaaggccggaacgggaggaagacgaaaggaggagttttaaagagggagggagtacattcaggtgacagatcgctttgacctgtacccctgttgtatatgacgcgctatgctggtattggtcgacgtttcgatctcttgaatgctacctgtggtcgacgtgtcgattgggcagtggaagccgaggagacttatggacccttatccccatcgcttctagtagtatccctcgattcggtgcgtgataacggtttttgcttgcaaagccgcgatgtgatttttccaactctggagtctgaagtagtagtagtatatttctctttacagcgagtatatatggaatttttttgagaattaatattatttttatggaaaatcgcaaaagtagtggccaaccggggaaaatcgcgaaagtaggtccctgtcgaacgggtgcaattcgataggacacctatcgaacaacgggcagtcgacaaacacctgtcgaacggctggcgttcgacacactcacctgtcgaacggagggagttcgaaagggcccaccaccggcgccgcgaggcctgtcgaaccgggggcgttcgacagcgctcacctgtcgaacggagggagttcgacagggcccaccacccggcgccgcgaggcctgtcgaaccgggggcgttcgacagggccctccaccgaccctgtcgaacaatcggcgtttgacaggccggtttaaaagccccgtccgcgagttcgatttgtttcgaggaccacatcgccagccgccgccgagagtcgccagttcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtacacgataaatttgtcataaatgccgtgtggccagtgaggggtcaacatggatggcagtggagagtagtggaggttgcgtcaactgggagttggaggaagtttgttagtaaagtaagggagaaaggctatagcccggcaat

SEQ ID NO: 41 - DNA, 1982 bp, Oryza sativa
  misc_feature (1)..(1982): AB077760 5'-regulatory sequence
  misc_feature (1)..(1583): 5'-nontranscribed sequence
  misc_feature (460)..(460): m is a or c
  misc_feature (1584)..(1864): exon
  misc_feature (1865)..(1965): intron
  misc_feature (1966)..(1982): exon
attcgttgggggtgacatgactagtcacgagctgcctatatgtaacactagaagaggcttctagtggtcgtagtagcttggtttggttgctggacaatgagagttggtagcaagaggtgcaccctgctgtccccccggttcagggataaaatgaagcacaggctggaacttagattgtctagagatggtaattggtcaattggtgaagttgtgacttgtgattacgagcatcttgctcttgcaggacattgctctccccttcgctcgtaattggtagtttgttgtcattggccttgtttggatcctccgggctattaaatagctatccggaatcttgctatttaggattattaaacgtagattaccgacaaaaccgatcccataacccctagactattttgcgagacgaatctaatgatgtatattaatccataattagcggctgattactgtagcatcmctgtagcaaatcatggattaatatacctcgttagattcgtttcgcaaaatagcctaggggttatggaatgagttttgtcagtattctaagtttaatactcttaaatagcaagatttcggagggctatttaatagccctccggatccaaacagggccattgtcttttaaaaacacctaggggtcttctggccagctccacgagatggtgggttagacggcctgggttcaaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaatggtgctaaccgttgggcggccagccacgcatgcagcgaatcggtcgatcgatcatgcagctgctaacacacacacaagagaagacgagacgaaactcagccggccggtgattcgatcgagagtaggtgacacagccaagcaggatagaggctatttttaggagagcttctagctgctgcaacttctctcagaattagaagctcccccaaacagtatatcttttggttcatattctaagaagttgtagttgtagaatccagaaagtgaaccagaagctagaagctgaaaaacctagcttttcaatattctcagaagctgtagttgtaaaatctagaaaatgaatcagaaaccaaaaaaatgaaaaatccagcttttctagattcttataaattgtctacaaatcagctgcttctcataattttaaactccacaaatactgcaggatccgtctccgcgaaccgagagacgttacggtatacggagtgggcacgattgctttcacgagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatggggaggggcaagatcgagatcaagcggatcgagaacgcgaccaacaggcaggtgacctactcgaagcgccgcacggggatcatgaagaaggccagggagctcaccgtgctctgcgacgcccaggtcgccatcatcatgttctcctccaccggcaagtaccacgagttctgcagcccttccaccgagtctgtatctccatctccacttcgactctatgatcttctccatcctgattatactatatatataactgcatcatatcgatcttaattgcatcctgctgcagcatcaaggggatctttg

SEQ ID NO: 42 - DNA, 986 bp, Oryza sativa
  misc_feature (1)..(986): AB077760 3'-regulatory sequence
  misc_feature (1)..(457): 3'-untranslated sequence
  misc_feature (458)..(986): 3'-nontranscribed sequence
tgatatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgccacgcttgctttattagctttgactatcaagctactgatcagagagttacctagctcaaaggattaattattatgtatacagctcaaatacattaatgggctactggctgctgctgtccgagtaattatttacacctgtggtatatcgcttagtccgttttgttgggattttgttgttggtcttgtgtcatcttggtgtgttttgttgtttttttctctttatttgtgtgttttttctttggctctttggggaggtttttacctcctatgttctcttcttaatgaaatggcgcacaattcttttgcgattttgaggaaaaaaaaaagattacctccgtggccaatcagcaagctcgccctcgccggcgccggtgagggcgaggagatcgccgttgttggctgttgtttgggctggacagcccaacaattactgctcagtagcccactctgggtgaaagcccgctcatcccgatagagttaacttccgtgggccgatttgtcgcgcaaccaaggtggcccgctccgcctccttcgttgcacgtgggcccataccacggtgaaaccatgtgtgggccttatttgggcttaactctggcccattaataatcgctggacagcgtccatgctagctactgcatttcttttttcgatttcagtaccacgg

SEQ ID NO: 43 - DNA, 1983 bp, Oryza sativa
  misc_feature (1)..(1983): AB077760 5'-regulatory sequence engineered
  misc_feature (1)..(1583): 5'-nontranscribed sequence
  misc_feature (460)..(460): m is a or c
  misc_feature (1584)..(1864): Exon
  misc_feature (1865)..(1965): Intron
  misc_feature (1966)..(1983): Exon
attcgttgggggtgacatgactagtcacgagctgcctatatgtaacactagaagaggcttctagtggtcgtagtagcttggtttggttgctggacaatgagagttggtagcaagaggtgcaccctgctgtccccccggttcagggataaaatgaagcacaggctggaacttagattgtctagagatggtaattggtcaattggtgaagttgtgacttgtgattacgagcatcttgctcttgcaggacattgctctccccttcgctcgtaattggtagtttgttgtcattggccttgtttggatcctccgggctattaaatagctatccggaatcttgctatttaggattattaaacgtagattaccgacaaaaccgatcccataacccctagactattttgcgagacgaatctaatgatgtatattaatccataattagcggctgattactgtagcatcmctgtagcaaatcatggattaatatacctcgttagattcgtttcgcaaaatagcctaggggttatggaatgagttttgtcagtattctaagtttaatactcttaaatagcaagatttcggagggctatttaatagccctccggatccaaacagggccattgtcttttaaaaacacctaggggtcttctggccagctccacgagatggtgggttagacggcctgggttcaaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaatggtgctaaccgttgggcggccagccacgcatgcagcgaatcggtcgatcgatcatgcagctgctaacacacacacaagagaagacgagacgaaactcagccggccggtgattcgatcgagagtaggtgacacagccaagcaggatagaggctatttttaggagagcttctagctgctgcaacttctctcagaattagaagctcccccaaacagtatatcttttggttcatattctaagaagttgtagttgtagaatccagaaagtgaaccagaagctagaagctgaaaaacctagcttttcaatattctcagaagctgtagttgtaaaatctagaaaatgaatcagaaaccaaaaaaatgaaaaatccagcttttctagattcttataaattgtctacaaatcagctgcttctcataattttaaactccacaaatactgcaggatccgtctccgcgaaccgagagacgttacggtatacggagtgggcacgattgctttcacgagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatcgggaggggcaagatcgagatcaagcggatcgagaacgcgaccaacaggcaggtgacctactcgaagcgccgcacggggatcatcaagaaggccagggtgctcaccgtgctctgcgacgcccaggtcgccatcatcatcttctcctccaccggcaagtaccacgagttctgcagcccttccaccgagtctgtatctccatctccacttcgactctatgatcttctccatcctgattatactatatatataactgcatcatatcgatcttaattgcatcctgctgcagcatcaagggccaccatgg

SEQ ID NO: 44 - DNA, 983 bp, Oryza sativa
  misc_feature (1)..(983): AB077760 3'-regulatory sequence engineered
  misc_feature (1)..(454): 3'-untranslated sequence
  misc_feature (455)..(983): 3'-nontranscribed sequence
tatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgccacgcttgctttattagctttgactatcaagctactgatcagagagttacctagctcaaaggattaattattatgtatacagctcaaatacattaatgggctactggctgctgctgtccgagtaattatttacacctgtggtatatcgcttagtccgttttgttgggattttgttgttggtcttgtgtcatcttggtgtgttttgttgtttttttctctttatttgtgtgttttttctttggctctttggggaggtttttacctcctatgttctcttcttaatgaaatggcgcacaattcttttgcgattttgaggaaaaaaaaaagattacctccgtggccaatcagcaagctcgccctcgccggcgccggtgagggcgaggagatcgccgttgttggctgttgtttgggctggacagcccaacaattactgctcagtagcccactctgggtgaaagcccgctcatcccgatagagttaacttccgtgggccgatttgtcgcgcaaccaaggtggcccgctccgcctccttcgttgcacgtgggcccataccacggtgaaaccatgtgtgggccttatttgggcttaactctggcccattaataatcgctggacagcgtccatgctagctactgcatttcttttttcgatttcagtaccacgg

SEQ ID NO: 45 - DNA, 2819 bp, Oryza sativa
  misc_feature (1)..(2819): AB095645 5'-regulatory sequence
  misc_feature (1)..(2130): 5'-nontranscribed sequence
  misc_feature (2131)..(2446): Exon
  misc_feature (2447)..(2803): Intron
  misc_feature (2804)..(2819): Exon
ctcgtcgccgtcgttggctcggcgtctcgccgccgtttacctttcccgtttccgagcccggagagggtatcgcttgccttgatggacgcgcgcgtgggccgggggaaatgtggtttggttgactcgcgcctgtcttgggccgtgattgattcagcccagtctgccagtttgctgtcttgaattctcggaggcccatgtagagaaatccatctatccacgtggaaacgtgggccatggccattgagcgaaatcagattagaaaaagtataatttgactccctcaactatcgcccgagtatgattcatatcctcccactacaaaacagatacatcgacccctacaattatcaaaaccaatgcaaacaatgtccctcggtggttttggctgaagtgtcgcctacgtggcggttttggctgagtctttgtcctacgtggcgcgtggcattagaataaaaaaatatgggacccatatgtcattcataaaaaaatatattatgggacccacatgtcatccttcctctccttcccttcttcctcccgtctttctctctcccttatctctctcccagcctttctgatcgaagcggcggtggcggcggtcgggagcagctgcggtggtggtggggagcggcgacgatggcggtcgggagcggcggctgtggcgatggggacgaggtggttgggagcagcggcggtagcagtggggacaaggcggtgggaaggggcggacgtgggccagtgctcgggcttgacggcggtgcagagtagggcgacctcggtgagcctcagcatgtcgccgtggcggtcccggtcggtgacgatctccacatcgaggatgtctgtcgaccactcatggctcagcgccagttgcgcccactccgccaggtcgtcgtcctcgtcgacggggaccttcccggtgaccacctcgagcagcacgagcccgaggcagaacacgtcggcatgggaggacagccgcctcccgcacgtgaactctgagcacttggccgccgcgagacgatgaccgtggtgcagaagcagcgggtagaacccgtggtcggtcaacttggccaccggcaccacgtcgccgccgctgccgggcgccgggaagacgacgagcacgttcgacgacttgaggttgccgtgcggcggccggtggacgaggtcgcctggctctggacacgcgcgtgcaccaccaccggacgccgccgtcgctccctaccgtcgtccccaccgccaccgccgccgctccagagagagagataagggagagagagggggaggaagaagggaaagagagggaagatgacatgtgggtcccacaatactttttattgtgtgaatgacatatgggtcctacatatttttttttgtttttattctaatgcaacgtaagcgctacgtaggactaagactgggtcaatactgccgcgtaggcgccacgtcagccaaaaccgcttccaaaaccacacaggaatatattttgcaccgattttaatagttagaggagtcaatatacctggttttgtggttggaggttatgaatcatactcgaggcatagttgagggaggccgtgtttagttgcaaattttctcttcaaacttcaaacttttccatcacatcaaaactttcgtacacacacaaacttccaactttttcgtcacattgttccaatttcaaccaaacttccaattttgaactaaacagcagccggagtcaaagtactttttccaatcagatttgagccgatcatgatttgaactcttcaaaactactagtaattttcagttcgaattcatgaaagttcacatcatgctatacctacacctagcatgtataggactggactgtattggtactagtactacagagtatcatagccgtacgggtatcatagacaagacaatacagaaagtacagtgtcctggaaacgtcaatgatcaaatcgaccatcaatccctcctcacctttcggctttccatcaaccggaatcaaatcggatagcgaagcaaagccaacggaagcaaagtaaacagggcattgccgtttctggagctcccctactgaaccgcctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcgggatggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgtgcgtccccccctcttctcctccccctggttcttttgcacataatatttttcagtgtactctttgtctagatgataaggtatatatgcaagaatcgttttgatgcaacaactaggttgaagatttttactctactccccaaaaaaagggaaaagggagatttttactctaccaacttgccaggaccggaactgtgtttttgtattggttaaagtcagtttcttttgcaggaaatgccatgtccttactctttttcctaaaatcggttttgagttatgctgatatagtatcttgaaccactcgcatctgttgcactgacatgcttgattaaccttccaatggtgggacatgtataaggctatcaagaatcttg

SEQ ID NO: 46 - DNA, 1170 bp, Oryza sativa
  misc_feature (1)..(1170): AB095645 3'-regulatory sequence
  misc_feature (1)..(376): 3'-untranslated sequence
  misc_feature (377)..(1170): 3'-nontranscribed sequence
taagctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtatgcttgtgttatcaccgcatttgtcagatggtgaatagtagtttgtgattgtaacaaacaatttatgcaagcttggtttcatgctaatgtcgtttcacttgcatttcaacacatgatatactgtcagttactgagttacatgactctgaggctctgagcatcagttagctaccacttacaaattaaagtacagtatatattatgcataatatcattagcattccaacacaaagacagtgatacactgtcatttacatcaactattggtgttgactaactctgaacatcagttggtctgcattcgttgcaattttacatgctgcaataaactgcagcattgcagcctgtaaaattgcagatccatggatgtctccaaactcaaaacatatttctcgttgcatccatcaacgattgataccattgccctcaccggagcatgtcgccgaagtccatgaacggggggccgctcagcacggacgaggcgctgaaattggcttcgccttcgtcgaacgcgatcctctggccgtacggctgcggccgttccggcaggtcgggcacgtccatgtcgccctccagcatcctcagcgcctccggcatggtggggcggcacgccacggtgacgtgcgcgcacaggatcccgacgagcacgaacctctccatggcgtgcaccccggcggggccctcccgctcgcgcagcgccgcggcgaccacctccgccgcgcgcccggccctgacgagcgcccacgcccagtcggtgatcagcacgacgccggaggggtcggacaggtcgagcgcgcgccggccgctcatcacctccagcaccagcacgccgaagctgtacacgtcgctcttctcggtgagctgcccgtacagcgcgtactccggcgagaggtagccgtgc

SEQ ID NO: 47 - DNA, 2820 bp, Oryza sativa
  misc_feature (1)..(2820): AB095645 5'-regulatory sequence engineered
  misc_feature (1)..(2130): 5'-nontranscribed sequence
  misc_feature (2131)..(2446): Exon
  misc_feature (2447)..(2803): Intron
  misc_feature (2803)..(2820): Exon
ctcgtcgccgtcgttggctcggcgtctcgccgccgtttacctttcccgtttccgagcccggagagggtatcgcttgccttgatggacgcgcgcgtgggccgggggaaatgtggtttggttgactcgcgcctgtcttgggccgtgattgattcagcccagtctgccagtttgctgtcttgaattctcggaggcccatgtagagaaatccatctatccacgtggaaacgtgggccatcgccattgagcgaaatcagattagaaaaagtataatttgactccctcaactatcgcccgagtatgattcatatcctcccactacaaaacagatacatcgacccctacaattatcaaaaccaatgcaaacaatgtccctcggtggttttggctgaagtgtcgcctacgtggcggttttggctgagtctttgtcctacgtggcgcgtggcattagaataaaaaaatatgggacccatatgtcattcataaaaaaatatattatgggacccacatgtcatccttcctctccttcccttcttcctcccgtctttctctctcccttatctctctcccagcctttctgatcgaagcggcggtggcggcggtcgggagcagctgcggtggtggtggggagcggcgacgatggcggtcgggagcggcggctgtggcgatggggacgaggtggttgggagcagcggcggtagcagtggggacaaggcggtgggaaggggcggacgtgggccagtgctcgggcttgacggcggtgcagagtagggcgacctcggtgagcctcagcatgtcgccgtggcggtcccggtcggtgacgatctccacatcgaggatgtctgtcgaccactcatggctcagcgccagttgcgcccactccgccaggtcgtcgtcctcgtcgacggggaccttcccggtgaccacctcgagcagcacgagcccgaggcagaacacgtcggcatgggaggacagccgcctcccgcacgtgaactctgagcacttggccgccgcgagacgatgaccgtggtgcagaagcagcgggtagaacccgtggtcggtcaacttggccaccggcaccacgtcgccgccgctgccgggcgccgggaagacgacgagcacgttcgacgacttgaggttgccgtgcggcggccggtggacgaggtcgcctggctctggacacgcgcgtgcaccaccaccggacgccgccgtcgctccctaccgtcgtccccaccgccaccgccgccgctccagagagagagataagggagagagagggggaggaagaagggaaagagagggaagatgacatgtgggtcccacaatactttttattgtgtgaatgacatatgggtcctacatatttttttttgtttttattctaatgcaacgtaagcgctacgtaggactaagactgggtcaatactgccgcgtaggcgccacgtcagccaaaaccgcttccaaaaccacacaggaatatattttgcaccgattttaatagttagaggagtcaatatacctggttttgtggttggaggttatgaatcatactcgaggcatagttgagggaggccgtgtttagttgcaaattttctcttcaaacttcaaacttttccatcacatcaaaactttcgtacacacacaaacttccaactttttcgtcacattgttccaatttcaaccaaacttccaattttgaactaaacagcagccggagtcaaagtactttttccaatcagatttgagccgatcatgatttgaactcttcaaaactactagtaattttcagttcgaattcatgaaagttcacatcatgctatacctacacctagcatgtataggactggactgtattggtactagtactacagagtatcatagccgtacgggtatcatagacaagacaatacagaaagtacagtgtcctggaaacgtcaatgatcaaatcgaccatcaatccctcctcacctttcggctttccatcaaccggaatcaaatcggatagcgaagcaaagccaacggaagcaaagtaaacagggcattgccgtttctggagctgccctactgaaccgcctcgaaagcctcctcatcaccattcctcttcctcccatcgcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcgggatcgggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgtgcgtccccccctcttctcctccccctggttcttttgcacataatatttttcagtgtactctttgtctagatgataaggtatatatgcaagaatcgttttgatgcaacaactaggttgaagatttttactctactccccaaaaaaagggaaaagggagatttttactctaccaacttgccaggaccggaactgtgtttttgtattggttaaagtcagtttcttttgcaggaaatgccatgtccttactctttttcctaaaatcggttttgagttatgctgatatagtatcttgaaccactcgcatctgttgcactgacatgcttgattaaccttccaatggtgggacatgtataaggctatcaaccaccatgg

SEQ ID NO: 48 - DNA, 1168 bp, Oryza sativa
  misc_feature (1)..(1168): AB095645 3'-regulatory sequence engineered
  misc_feature (1)..(372): 3'-untranslated sequence
  misc_feature (373)..(1168): 3'-nontranscribed sequence
gctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtatgcttgtgttatcaccgcatttgtcagatggtgaatagtagtttgtgattgtaacaaacaatttatgcaagcttggtttcatgctaatgtcgtttcacttgcatttcaacacatgatatactgtcagttactgagttacatgactctgaggctctgagcatcagttagctaccacttacaaattaaagtacagtatatattatgcataatatcattagcattccaacacaaagacagtgatacactgtcatttacatcaactattggtgttgactaactctgaacatcagttggtctgcattcgttgcaattttacatgctgcaataaactgcagcattgcagcctgtaaaattgcagatcgatggatgtctccaaactcaaaacatatttctcgttgcatccatcaacgattgataccattgccctcaccggagcatgtcgccgaagtccatgaacggggggccgctcagcacggacgaggcgctgaaattggcttcgccttcgtcgaacgcgatcctctggccgtacggctgcggccgttccggcaggtcgggcacgtccatgtcgccctccagcatcctcagcgcctccggcatggtggggcggcacgccacggtgacgtgcgcgcacaggatcccgacgagcacgaacctctccatgccgtgcaccccggcggggccctcccgctcgcgcagcgccgcggcgaccacctccgccgcgcgcccggccctgacgagcgcccacgcccagtcggtgatcagcacgacgccggaggggtcggacaggtcgagcgcgcgccggccgctcatcacctccagcaccagcacgccgaagctgtacacgtcgctcttctcggtgagctgcccgtacagcgcgtactccggcgagaggtagccgtgcg

SEQ ID NO: 49 - DNA, 7018 bp, Oryza sativa
  misc_feature (1)..(7018): AB139664 5'-regulatory sequence
  misc_feature (1)..(1557): 5'-nontranscribed sequence
  misc_feature (1558)..(1747): Exon
  misc_feature (1748)..(7001): Intron
  misc_feature (7002)..(7018): Exon
tgcatccttacaaagagacagatagatccaatcgtacaattaaatcagtaattttataagagaatgaaataacattctagctagtgtatccaagaatgcacagtgaagtccgtatttaagtcccatccaaaacgatgtgatgttagatctgatccaaaatatttaataatgtagctcaagttttgcatagcccctgagaaccagacaagccaatgttaaaattcctactgtgcatagggagggcaatcaatcatcctactgcatgagtaggtccctgcttcctgttcaaaatactttctccgttctacgaagactacatttttagaacaaagctaacaaactaatggtgagagaagaaaaatcaaatgaacactcattaatacgaaaataaattatcgtcaaatgataacctaggaataattttgagttacagattaattataggtaagaaagaacaaagttaaagcgatcgaaaatgaagtctatttaaggaccagtttagtatggctctagctatagctccactcattctatagctggagtccaaccaaatagtttctacacctaaaatagaaatatagttggctagagcgttatcacaaaataaactagagaggtggagttgagttcagaccgctacacaacttcactttaaactttaactcctaaagttaaattttaagagatgaagatctactaaacaggctttaatacggaggaaatgcattcatccacaaaggtcaaaagcagcagaaagagaacgaatgcctttgctgcattcaacccaaagcagagctgcaggggtgccaactgccaatcaggcaatcatccactctgggagcgacaggcgacgccattgatgggcacaccccctcgccggggccgacgggagacgagacgacgcaggcactgttttgcggccgacccaagccaagccaagccaggagccatcccgtcccatcacgacgcattgctgccgcggcctaattgggcaggaaaagccatggcccacccccaccgcctggccagacgagacggcccaaaaaaggatcggcccagaaaagcccacgagagtacgacgcacgcacgcgtcgccgggaggcggggcccgggccggcgccgcctcgcccaatggccgttcgacagcggaggcgatcgaaaccaccccggtatcgccaaaccgcctcctcctcctccgacgatccggcgcgcgctccctttaaaatccccccatttcctcctcctcctcctcctcgtcgtcgtcgtctcccccactcgatcgatccatccatcgatcgatcggtcccccccatcgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggaagggaggaggaggaggaggaggaggaggaggaagaacaggaggaagatggggcggggcaaggtgcagctgaagcggatcgagaacaagatcaaccggcaggtgaccttctccaagcgcaggtcggggctgctcaagaaggcgaatgagatctccgtgctctgcgacgccgaggtcgcgctcatcatcttctccaccaagggcaagctctacgagtacgccaccgactcatggtacgtacgtacgtacgtgtgcttgattaaatttcatcctcatcgcttgtctctaagctttcagttcttttcgcttaatcgagcaatccttgcgctacatgatgtgttcccgtttccgttctgttcgtatcgatcgattgcctttgaattctgtgtgtgattaattcgatctgtcctgattgctcgaattaattttgttgcgtgtgtttcggggttatccccaataatctgtttgaatttctgctgcgattgttgattgcttgccggcgatggaggaggcagcgtgttttgctatttcaggctttgagctgacggcgtgaggtgagatgcgttgcatctgtgcactgtagctacagtgcccgtacgagggtaattttatgctccgctttcgctggagagggcgttgctgctgcgctatttggggaatttttttttggccctgccgatgggtgctgcttgcttggcgacaagctagctttgcacccaaaggggagaggggtgattagctaggaactctagtacgtagatttgatggacctgggattatttggggattaaaatggtcttggcttgtgttcatctaaaattctactgaacttgctgcttgtgttgtgtgtgcctcttctttcttcactattccccatattaattctgggctcgtttagatcttctttctctctccctggccatctctttctcttgaggcaactaagcatattaagggagaagatgaaacgggatgcatcgggagatggaggagttcatatcttaagctgctggtgacttgttggaacccttttcgctggttcgtctgcctctagctttcttggactctttgctgatgcatgccatgcttttcagaacgaaaagattttactagaacaaacttataagctagggctggcctttaatctttacttcttaattcccggctgtcattagttcaatctaatggttcattagttgctgggttctacctttcctataaggttctttttgagatgtacatggtttctgaagaaacatccatgcttctagctagcctgattacagactggtttcatgctgcttcttttttatcgaaaagtcaccttgggggagagtttcccacttaactcattcgattttcttagttcagaggggaggtacaaaggttacaacattacatcggaggtctgttaagatgttaagacttagtaagaggtagagaggagttaacaggaaaaaaaagaacttataagctaaaggttcatcctagttagcgctttagttgctgggttctaccttttctgtcaggttcttcttgggatgtgcatatggttcctgaagaaacagacattagaaatttagaactaagaagcaaaacgttggatgcttccagtataccatatcatctgaaggatatttatccttcttgatgttttcgacaatgatttactattaatgcattgttatgcaagctttgttaagtcaacatgcaaatcttagagtttgatggttaattccagttcttatatattttttaagttaaaaattttcttatctctcctttttcctcactacatacgaatagagtttgatctggctgttataaattttcttcagttttgtgggcatccttatatctactaatcagactccccatatgatcagtgattatcagcttatactctattctaattctatgaatgaacgactaattaacttaattaactcctcgctgatttaatccaataagggtagtgtgttgggcatccccataatgctagcaaccacatctctagataagagtcattagtatcacatattttgaaatccttctcactctaaccattgatcagtgagttaagacataggagtagagcttcacgtgaggtaacagtgtttggatttcaaggtatcaagtttggggtgggagtacacgagccgatggattaatctgatttttttttcgtttctcgtacgtcattaaacgtcttatttggaaatcaactccattaggttcctgcagggtactgtagttatgctaattaatccttcttaagacttttccaagatttagctttaaacagatgctttcatgaacctagttgggaaacatgacaaatcctcttcgaactttaattaagatgttactttaattagcatgccttaagctggcatacgtagcggcaaatgcaaccacttacaattcatcacaaggcaatagatcgactggctttcttgttaaagctaagcaagtagttacctactgcgccaataagaatattgagcctactccattggtacgatgggtaatatttataaatgcttgtcgtttaggagtagcaagacactagttctttcatatttgtttgggtgccaatttagaaaactctccgtacttcaaatgtagtaaaatactctcctactgctctttggacgatgaacgtctacacagacaaacagtagtcatatttgaagtgactcgggagatattttaattctttttaactataagcagtagaattgtaaagttggtttcctccatcttaatccaatgcacgaagttcagaactctgctttgattaatagagctcgcagcgacttgcatgctgttttcacaacaagactcttgtagtattgcatctagccgtatatagatgagtcggcaatgagttaactctggctctcactgtctcacacgctattagggttccagacttccagtctacttgattcagaaaaatacaaatattctcttataagttagcccaaaataataaaatggatatatatttgcgggcattaattggtctaactatgctcggaggcctactggtccaactcgcgtaggacatacaaactcataaccgcataatatacctgttcagctatttggttatacagtattgagttgattcctgctgttgactgaactgtagcaacgtctgtatatatccgggactaatgataaattttcagtttggattgcattattcacaatatcttttaagcattaatactgtattaattctcttgacacttcatttttgtaataattttgttaattttccataggttgattaatttcaagttatcctatatacttatatagttcatctccactaagtgtagttaatgatatttctctcctcttattagactacattaccccaattatttctagccattggataatagatatatggttcaaattttctcttctttcttctctcattacaccaagtaatctcaatcatttttaggccttaaactcataagtatcaatttgttttagttttaatattcatatttcatcttatttgtacatattatgcaacttaatttcccgcagcaacgcggcagagtattcatttagttaatgtagacaacccaatatcacatgtgatcttacttgattatcattgattagaccctgtctaggaataagaagcaaatatgttctctttcaacaaagttatgtttgcttaagagtctagggtgttgtatttccccttaattctttctatagatagttatacttgctatcctgtttcatttctttttcttaacgaaaatgagatacagttcagttgcttaagcttttcttgacatgtatgcttgtattacatgtttaccttgactttgccccagaagtataccttctatatatatgcatattatctttccccaaaaggttatacagacccttttgaaaggttgacattttagtatgccgtagaaagtatatatcctttggttataaagtgaacttgttcaaagtgcctcaagaacatggaaatactttagcaaacaatgaagctactccctccatttataattcatttcatattataagttactttgaatttatttcctagtcaaactattttaagttcgactaaatttatagaaaaaaataaaaatatttctaacacaaaataaacattttatcaaatatgttcaatattaaatttaacgaaactaatttggtattgttgatgttgctattttttttctataaattggtcaaatgtaaagatgcttgacttgggaaaaagtcaaaacgacttgtaatatgaaacggatggagtaagacttaataatgtttcagaacttgaaccatatcagtgctaccaccaaaagctgatcattctgatatatgaaaatgtttattgttagctttgcccaaaaaaccgttttcatgaactgcataaatacaacaatttattgtttttttagggttctgtgtgtgggggggtggtgtgttaatccaactcttgtgttagaagtagattggcaaatctattctgtattatatcttacataagttcttataagaataaactgcaaaatgtaggtgttgttatttacaccactacgaagtacccccatttaaattttgaatgtataacaccgttgacttttatacatatgtttgaccgttcgtcttattaaaaaatacgtaattgtcatttattttgttgtgatgtgttttaagcatcaaaggtagtttaagcatgacttttttttacataattgcaaaaaagaatttgaataaaacaaatggcattttattatgggttacgcatttacatgtcataatatccactgtgacatttgagaaacctattcatgttttgaactagagattattagtagttgagggcctttgttagatgctgctagtcctatgattttggttagtacatgtatggcaagtgaaatcgtattgatattatattcccacacaatatgtaagttacttcaacacataaatatataacaatatctagttttgtattacttatatatatatattctcatcatagtgatagtcactaacttacctattaagacattcaaagaaatgggcatccttcagttaggatgttacagtgatacaccttttcgttttgacaatactgcatacgcagtttctaaaacaactccatgttaaaacataaggggttgcactcaagtagattttgaagtgtgtgtgcgcgcctgtgcaactttcttgttcttccttcgttttattttaaacctggaaactaaagtaggtttcctgttaaattcctatcctttcttaaaaaaatggacttcaagaaaaaacagaccagaatcataaatacagtgtatgtatctgacctgtatatgaaaaggtacagccatatgtgcatttgttgttgagatggaagaatatatatactgcttagttattattacaattatttcaaatgatgaaacgtatattcctcatttttcacagtatggacaaaatccttg

SEQ ID NO: 50 - DNA, 1372 bp, Oryza sativa
  misc_feature (1)..(1372): AF139664 3'-regulatory sequence
  misc_feature (1)..(372): 3'-untranslated sequence
  misc_feature (373)..(1372): 3'-nontranscribed sequence
taaggaggcttcagatccataccagtaatcacaagttgcaacctgacccggtccggtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagtagcatgaacaaattttcccgtttccaaccatctccattggtgtcatgtgtgacttaaatagcgaaatttcagcattgtgcatagtgtgattactgtaagataaataaactttgtagacaataagtctccgttatcttgctgattggagctgaatctgtccgatcaccggcagagctgattgagcgcatactgcataacgaataaattgtatgcgaacaagttgataggcataaatcgttcgactgtttacaaagaaaataaggcgtgacattctcagttaaataatgggagatcatcttgtatataatgatcttctgccgtcactcctatacaaacattttacccattacaaaaaccaagaaatataccaaggcgcccaagctcactgtcactgctgactcccctaccactaaaaattctcaagagaggataacgaatgctaagcattagtcttctaagaatggcattcagaactgtggaactatgtgccggctgatgagaactcagcctatgaataaattaatctagccacaactttaacataaagatattggtcagaggttgtatttaactgaacagggatatgctagtattaaactcgaagcatcttctctttcaggcgtgaaatgaacttgaatgtctcctctgctttgacctgttgatacatatcacttcttgatactctgtccggatggaatttcaaaagagcttgcttgtaagcagctttaacctgaaaaaagtttcatattaaacaattgtcagcgggaagagatcaataattccttatttacatttatgggtatcattttatgaacttatatcagaacatggcataaggtggtaattgatctcgcctagattgccagaggcaataattggcaaatcttccaaaatttgtcatgagaagctatctcttctataaataaacaaacgaatttgggatttctccatagaaaattgaaatacaatttccaagtgcatatatctatctatgcatatgccacaacaataacaagtaataagttaattcactcgaagtaacagattcgtaagttggtttcatatggtacataaaacataactacttccatttcataatgtttgccaattttcctaagaaatgttgcttcacaatgtttatcc

SEQ ID NO: 51 - DNA, 7019 bp, Oryza sativa
  misc_feature (1)..(7019): AF139664 5'-regulatory sequence engineered
  misc_feature (1)..(1557): 5'-nontranscribed sequence
  misc_feature (1558)..(1747): Exon
  misc_feature (1748)..(7001): Intron
  misc_feature (7002)..(7019): Exon
tgcatccttacaaagagacagatagatccaatcgtacaattaaatcagtaattttataagagaatgaaataacattctagctagtgtatccaagaatgcacagtgaagtccgtatttaagtcccatccaaaacgatgtgatgttagatctgatccaaaatatttaataatgtagctcaagttttgcatagcccctgagaaccagacaagccaatgttaaaattcctactgtgcatagggagggcaatcaatcatcctactgcatgagtaggtccctgcttcctgttcaaaatactttctccgttctacgaagactacatttttagaacaaagctaacaaactaatggtgagagaagaaaaatcaaatgaacactcattaatacgaaaataaattatcgtcaaatgataacctaggaataattttgagttacagattaattataggtaagaaagaacaaagttaaagcgatcgaaaatgaagtctatttaaggaccagtttagtatggctctagctatagctccactcattctatagctggagtccaaccaaatagtttctacacctaaaatagaaatatagttggctagagcgttatcacaaaataaactagagaggtggagttgagttcagaccgctacacaacttcactttaaactttaactcctaaagttaaattttaagagatgaagatctactaaacaggctttaatacggaggaaatgcattcatccacaaaggtcaaaagcagcagaaagagaacgaatgcctttgctgcattcaacccaaagcagagctgcaggggtgccaactgccaatcaggcaatcatccactctgggagcgacaggcgacgccattgatgggcacaccccctcgccggggccgacgggagacgagacgacgcaggcactgttttgcggccgacccaagccaagccaagccaggagccatcccgtcccatcacgacgcattgctgccgcggcctaattgggcaggaaaaggcatggcccacccccaccgcctggccagacgagacggcccaaaaaaggatcggcccagaaaagcccacgagagtacgacgcacgcacgcgtcgccgggaggcggggcccgggccggcgccgcctcgcccaatggccgttcgacagcggaggcgatcgaaaccaccccggtatcgccaaaccgcctcctcctcctccgacgatccggcgcgcgctccctttaaaatccccccatttcctcctcctcctcctcctcgtcgtcgtcgtctcccccactcgatcgatccatccatcgatcgatcggtcccccccatcgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggaagggaggaggaggaggaggaggaggaggaggaagaacaggaggaagaaggggcggggcaaggtgcagctgaagcggatcgagaacaagatcaaccggcaggtgaccttctccaagcgcaggtcggggctgctcaagaaggcgaatgagatctccgtgctctgcgacgccgaggtcgcgctcatcatcttctccaccaagggcaagctctacgagtacgccaccgactcaaggtacgtacgtacgtacgtgtgcttgattaaatttcatcctcatcgcttgtctctaagctttcagttcttttcgcttaatcgagcaatccttgcgctacatgatgtgttcccgtttccgttctgttcgtatcgatcgattgcctttgaattctgtgtgtgattaattcgatctgtcctgattgctcgaattaattttgttgcgtgtgtttcggggttatccccaataatctgtttgaatttctgctgcgattgttgattgcttgccggcgatggaggaggcagcgtgttttgctatttcaggctttgagctgacggcgtgaggtgagatgcgttgcatctgtgcactgtagctacagtgcccgtacgagggtaattttatgctccgctttcgctggagagggcgttgctgctgcgctatttggggaatttttttttggccctgccgatgggtgctgcttgcttggcgacaagctagctttgcacccaaaggggagaggggtgattagctaggaactctagtacgtagatttgatggacctgggattatttggggattaaaatggtcttggcttgtgttcatctaaaattctactgaacttgctgcttgtgttgtgtgtgcctcttctttcttcactattccccatattaattctgggctcgtttagatcttctttctctctccctggccatctctttctcttgaggcaactaagcatattaagggagaagatgaaacgggatgcatcgggagatggaggagttcatatcttaagctgctggtgacttgttggaacccttttcgctggttcgtctgcctctagctttcttggactctttgctgatgcatgccatgcttttcagaacgaaaagattttactagaacaaacttataagctagggctggcctttaatctttacttcttaattcccggctgtcattagttcaatctaatggttcattagttgctgggttctacctttcctataaggttctttttgagatgtacatggtttctgaagaaacatccatgcttctagctagcctgattacagactggtttcatgctgcttcttttttatcgaaaagtcaccttgggggagagtttcccacttaactcattcgattttcttagttcagaggggaggtacaaaggttacaacattacatcggaggtctgttaagatgttaagacttagtaagaggtagagaggagttaacaggaaaaaaaagaacttataagctaaaggttcatcctagttagcgctttagttgctgggttctaccttttctgtcaggttcttcttgggatgtgcatatggttcctgaagaaacagacattagaaatttagaactaagaagcaaaacgttggatgcttccagtataccatatcatctgaaggatatttatccttcttgatgttttcgacaatgatttactattaatgcattgttatgcaagctttgttaagtcaacatgcaaatcttagagtttgatggttaattccagttcttatatattttttaagttaaaaattttcttatctctcctttttcctcactacatacgaatagagtttgatctggctgttataaattttcttcagttttgtgggcatccttatatctactaatcagactccccatatgatcagtgattatcagcttatactctattctaattctatgaatgaacgactaattaacttaattaactcctcgctgatttaatccaataagggtagtgtgttgggcatccccataatgctagcaaccacatctctagataagagtcattagtatcacatattttgaaatccttctcactctaaccattgatcagtgagttaagacataggagtagagcttcacgtgaggtaacagtgtttggatttcaaggtatcaagtttggggtgggagtacacgagccgatggattaatctgatttttttttcgtttctcgtacgtcattaaacgtcttatttggaaatcaactccattaggttcctgcagggtactgtagttatgctaattaatccttcttaagacttttccaagatttagctttaaacagatgctttcatgaacctagttgggaaacatgacaaatcctcttcgaactttaattaagatgttactttaattagcatgccttaagctggcatacgtagcggcaaatgcaaccacttacaattcatcacaaggcaatagatcgactggctttcttgttaaagctaagcaagtagttacctactgcgccaataagaatattgagcctactccattggtacgatgggtaatatttataaatgcttgtcgtttaggagtagcaagacactagttctttcatatttgtttgggtgccaatttagaaaactctccgtacttcaaatgtagtaaaatactctcctactgctctttggacgatgaacgtctacacagacaaacagtagtcatatttgaagtgactcgggagatattttaattctttttaactataagcagtagaattgtaaagttggtttcctccatcttaatccaatgcacgaagttcagaactctgctttgattaatacagctcgcagcgacttgcatgctgttttcacaacaagactcttgtagtattgcatctagccgtatatagatgagtcggcaatgagttaactctggctctcactgtctcacacgctattagggttccagacttccagtctacttgattcagaaaaatacaaatattctcttataagttagcccaaaataataaaatggatatatatttgcgggcattaattggtctaactatgctcggaggcctactggtccaactcgcgtaggacatacaaactcataaccgcataatatacctgttcagctatttggttatacagtattgagttgattcctgctgttgactgaactgtagcaacgtctgtatatatccgggactaatgataaattttcagtttggattgcattattcacaatatcttttaagcattaatactgtattaattctcttgacacttcatttttgtaataattttgttaattttccataggttgattaatttcaagttatcctatatacttatatagttcatctccactaagtgtagttaatgatatttctctcctcttattagactacattaccccaattatttctagccattggataatagatatatggttcaaattttctcttctttcttctctcattacaccaagtaatctcaatcatttttaggccttaaactcataagtatcaatttgttttagttttaatattcatatttcatcttatttgtacatattatgcaacttaatttcccgcagcaacgcggcagagtattcatttagttaatgtagacaacccaatatcacatgtgatcttacttgattatcattgattagaccctgtctaggaataagaagcaaatatgttctctttcaacaaagttatgtttgcttaagagtctagggtgttgtatttccccttaattctttctatagatagttatacttgctatcctgtttcatttctttttcttaacgaaaatgagatacagttcagttgcttaagcttttcttgacatgtatgcttgtattacatgtttaccttgactttgccccagaagtataccttctatatatatgcatattatctttccccaaaaggttatacagacccttttgaaaggttgacattttagtatgccgtagaaagtatatatcctttggttataaagtgaacttgttcaaagtgcctcaagaacatggaaatactttagcaaacaatgaagctactccctccatttataattcatttcatattataagttactttgaatttatttcctagtcaaactattttaagttcgactaaatttatagaaaaaaataaaaatatttctaacacaaaataaacattttatcaaatatgttcaatattaaatttaacgaaactaatttggtattgttgatgttgctattttttttctataaattggtcaaatgtaaagatgcttgacttgggaaaaagtcaaaacgacttgtaatatgaaacggatggagtaagacttaataatgtttcagaacttgaaccatatcagtgctaccaccaaaagctgatcattctgatatatgaaaatgtttattgttagctttgcccaaaaaaccgttttcatgaactgcataaatacaacaatttattgtttttttagggttctgtgtgtgggggggtggtgtgttaatccaactcttgtgttagaagtagattggcaaatctattctgtattatatcttacataagttcttataagaataaactgcaaaatgtaggtgttgttatttacaccactacgaagtacccccatttaaattttgaatgtataacaccgttgacttttatacatatgtttgaccgttcgtcttattaaaaaatacgtaattgtcatttattttgttgtgatgtgttttaagcatcaaaggtagtttaagcatgacttttttttacataattgcaaaaaagaatttgaataaaacaaatggcattttattatgggttacgcatttacatgtcataatatccactgtgacatttgagaaacctattcatgttttgaactagagattattagtagttgagggcctttgttagatgctgctagtcctatgattttggttagtacatgtatggcaagtgaaatcgtattgatattatattcccacacaatatgtaagttacttcaacacataaatatataacaatatctagttttgtattacttatatatatatattctcatcatagtgatagtcactaacttacctattaagacattcaaagaaatgggcatccttcagttaggatgttacagtgatacaccttttcgttttgacaatactgcatacgcagtttctaaaacaactccatgttaaaacataaggggttgcactcaagtagattttgaagtgtgtgtgcgcgcctgtgcaactttcttgttcttccttcgttttattttaaacctggaaactaaagtaggtttcctgttaaattcctatcctttcttaaaaaaatggacttcaagaaaaaacagaccagaatcataaatacagtgtatgtatctgacctgtatatgaaaaggtacagccatatgtgcatttgttgttgagatggaagaatatatatactgcttagttattattacaattatttcaaatgatgaaacgtatattcctcatttttcacagtatcgacaaccaccatgg

SEQ ID NO: 52 - DNA, 1383 bp, Oryza sativa
  misc_feature (1)..(1383): AF139664 3'-regulatory sequence engineered
  misc_feature (1)..(382): 3'-untranslated sequence
  misc_feature (383)..(1383): 3'-nontranscribed sequence
ggaggcttcagatcggaggcttcagatccataccagtaatcacaagttgcaacctgacccggtcccgtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagtagcatgaacaaattttcccgtttccaaccatctccattggtgtcatgtgtgacttaaatagcgaaatttcagcattgtgcatagtgtgattactgtaagataaataaactttgtagacaataagtctccgttatcttgctgattggagctgaatctgtccgatcaccggcagagctgattgagcgcatactgcataacgaataaattgtatgcgaacaagttgataggcataaatcgttcgactgtttacaaagaaaataaggcgtgacattctcagttaaataatgggagatcatcttgtatataatgatcttctgccgtcactcctatacaaacattttacccattacaaaaaccaagaaatataccaaggcgcccaagctcactgtcactgctgactcccctaccactaaaaattctcaagagaggataacgaatgctaagcattagtcttctaagaatggcattcagaactgtggaactatgtgccggctgatgagaactcagcctatgaataaattaatctagccacaactttaacataaagatattggtcagaggttgtatttaactgaacagggatatgctagtattaaactcgaagcatcttctctttcaggcgtgaaatgaacttgaatgtctcctctgctttgacctgttgatacatatcacttcttgatactctgtccggatggaatttcaaaagagcttgcttgtaagcagctttaacctgaaaaaagtttcatattaaacaattgtcagcgggaagagatcaataattccttatttacatttatgggtatcattttatgaacttatatcagaacatggcataaggtggtaattgatctcgcctagattgccagaggcaataattggcaaatcttccaaaatttgtcatgagaagctatctcttctataaataaacaaacgaatttgggatttctccatagaaaattgaaatacaatttccaagtgcatatatctatctatgcatatgccacaacaataacaagtaataagttaattcactcgaagtaacagattcgtaagttggtttcatatggtacataaaacataactacttccatttcataatgtttgccaattttcctaagaaatgttgcttcacaatgtttatcc

SEQ ID NO: 53 - DNA, 4411 bp, Oryza sativa
  misc_feature (1)..(4411): AF139665  5'-regulatory sequence
  misc_feature (1)..(1406): 5'-nontranscribed sequence
  misc_feature (1338)..(1338): y is c or t
  misc_feature (1407)..(1667): Exon
  misc_feature (1668)..(4394): Intron
  misc_feature (4395)..(4411): Exon
acctggggtttggaaatggggagcggcgcgagggaaccgagctagggagggatgggtcacggagggagagggagagggggccgtatggaagagtggtggctaagtgggtcagctgatgtctgatgggtcatgacggagtgggtcgggttggtaggaggcgttgcaagaggccagttggactgtgtttggatcgaagaattgaggatttaggtgcactaatatgtgtacatgtgtatatactaaaagtatacttgttttttgataaaaaagttgggtattcccgggaatacccaggaatcatggtagctccgcccctgtgtgtagccaaaggtcatttacctatctgcaattttgcaatcaaccacggtagcatagcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagaaaaaaaaatctttcaacaccaacaaacaaacgctggtactcccagtacgtgtattgtactactaggtagtactcggtgccaaacagtttggcggctatacggagttgagtagtacaaacagaaatactcgtatcgtatcggaatttctaaaaagaaaaaaataaaataaaagaaaaacctgtactggcaggtgggccccacccgcccgcttcgacgaccacacgtgggctcgccacgtgtcatccggcgtctcgtttccttgtacccgacacccccctacgttgtggaaaaagaaaaacccatccctcacgcgagcccaccgcacccgcagtcacagacaagcgggccccatccgacccaccgaccaatcccgagcgcgagcccgcgggtgcacgggttcgcgcgcgccgcgtggcccgtgggccccaccgggccagggccgcggtaacgacctctctcctgatccgacggccgggatccctccacgccgccccgaaaccgcctcggccaatcggaaatcgacaacgaggcactcgaaaccgccctggtatggccacaccgcattccacccccatctaaaaccgccttccctccccctccctctytcttcctccccccatttccatcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccaggtacgcacgcgcttagctcctcctcctcctcctcctcctctccgcgacctcccgcctacctacgtagtacggcccatgcccgtcgcctttcctcgccgcgcgcgcgccatgggcgagctcgcggagctccccgttcctgggcggcttgttgatgcgttcgatttcgtttcgtacgggttcctgccttgtgttcgatcgtttccgctgcggaatgcgagggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtattcctatactctattatttcataatatttggcaattttgaccggtgattgcttcagtttaaccattaatatcttttaaaatttatgattatgatggatgggatttatatctctatatttaccattaccatgtaacatactttaataatatgttacataatctaatactaaaagtttatttataaaattggaatggccaaactaaaacaatgcgaacttaaaatcaccaagtattatgaaatggagggagcataatatcagtagctcgtaagggaaaaaagggacctaaatgatgccttttgtgataaatataatttcaaatttgcaaaatttttggataggcaacaatactctctcattattgtgttagtattaaggtcaagctacttctatgctaccaaatactccttctgttcctttttttatttcttgtctaggatattgacattatccctaacacacatctttctttgtatgatcatctactcataaaatagttaaaatataactacattattcaattatgaatctatgaatgttatttttatacaccgagttgggaactattctaaactctcgaggggacatcccctcattatctgcatgttatccaaacggttgtgaaaaaaattgaaaaaaaataaacaagatagattaatatgtgataaatcactccacaaacatgcaaggacaaattcaaattctacaagttgcaatgaaaaaattaaatttgaccgtgaatatacattaactagccatagtttaatttttttttgttgtaacttgtagaagttgaatttgaacttgcatgtttgtgaagtaatctatcacatattaatctatcttgtcgatttttttttaaaaaaatcataaccatttagatgacatgcaaaaaacgaggggatgttcccttgagagtttagaatccattctccagtgagttgatgttgagatttgattacacatttcaaaacgacttttatttgttaacgaagggagtaatgtggattcaccatatgtactaatgttattaaggccagataatcctttttttaatcattctaattagatataaacttacgacgaagaacatgaatggataaagtttcagccaacaaatacaaatgtttttcaaagtgctatttctgatgcataatttttgtagcagttatgatttaaatttatacatggataatttgaataatggatcctacttttgtagttgtcacctgacaagccttaagaattattgagggtacaaaaattataactgtgcatttgtttgatattgctctaagactatgcttggcatcatcttttgatgcattggtcaaaccaaagcataatcatgtgatacttcttctgtagtatggaagggatccttg

SEQ ID NO: 54 - DNA, 955 bp, Oryza sativa
  misc_feature (1)..(955): AF139665 3'-regulatory sequence
  misc_feature (1)..(359): 3'-untranslated sequence
  misc_feature (360)..(955): 3'-nontranscribed sequence
tgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctctgatcgatgagtagtccttggtccgagattgtagagccgtgtatgtttcctctcgtcgttgtgctctgtatgcaatcgacggagatgtggtttaacttgtctcacctgctgtgatttcctttcatctgttcttcagatgtaagaaaacgaacagcgccaccgccttttcaaggattaaaagagtaggattcagaactttttttttagagaggagaatcaaaacgcttcctggttatctgaaatctgatgtcagatgccttaaacccttgactgaaagggaagtggttatctgaaatctgatgtcagatgccttaaacccttaactgaaagggaagaggtttgtcagctctgtttcaaactgtatcactgtcatcttgtccgaatctcaaggaaaaaaaatctcttctcatatactccatcttaaaaaaaactcaatttctgaagtttaaattttgtcaaaaaaaatcaacttctactgtcctgcctattttcagcacgtaaaacgagaagttttatcccttaaataccgtttacatatctatcatcattactatttttttttaaataataagggacattttagttgtctttactcctcactaaatttgcattgggatgctaagaatgctctttttatgggacggagggagtattgttccatagcaggttaatgctaaggctgagttcccgaggtggagttcat

SEQ ID NO: 55 - DNA, 4412 bp, Oryza sativa
  misc_feature (1)..(4412): AF139665 5' regulatory sequence engineered
  misc_feature (1338)..(1338): y is c or t
acctggggtttggaaatggggagcggcgcgagggaaccgagctagggagggatgggtcacggagggagagggagagggggccgtatggaagagtggtggctaagtgggtcagctgatgtctgatgggtcatgacggagtgggtcgggttggtaggaggcgttgcaagaggccagttggactgtgtttggatcgaagaattgaggatttaggtgcactaatatgtgtacatgtgtatatactaaaagtatacttgttttttgataaaaaagttgggtattcccgggaatacccaggaatcatggtagctccgcccctgtgtgtagccaaaggtcatttacctatctgcaattttgcaatcaaccacggtagcatagcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagaaaaaaaaatctttcaacaccaacaaacaaacgctggtactcccagtacgtgtattgtactactaggtagtactcggtgccaaacagtttggcggctatacggagttgagtagtacaaacagaaatactcgtatcgtatcggaatttctaaaaagaaaaaaataaaataaaagaaaaacctgtactggcaggtgggccccacccgcccgcttcgacgaccacacgtgggctcgccacgtgtcatccggcgtctcgtttccttgtacccgacacccccctacgttgtggaaaaagaaaaacccatccctcacgcgagcccaccgcacccgcagtcacagacaagcgggccccatccgacccaccgaccaatcccgagcgcgagcccgcgggtgcacgggttcgcgcgcgccgcgtggcccgtgggccccaccgggccagggccgcggtaacgacctctctcctgatccgacggccgggatccctccacgccgccccgaaaccgcctcggccaatcggaaatcgacaacgaggcactcgaaaccgccctggtatggccacaccgcattccacccccatctaaaaccgccttccctccccctccctctytcttcctccccccatttccatcttccccgagctctccaccctccacccgccaccgccaccgccgccttcgccgccgccgccgccgccgacgacgatcgggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccaggtacgcacgcgcttagctcctcctcctcctcctcctcctctccgcgacctcccgcctacctacgtagtacggcccatgcccgtcgcctttcctcgccgcgcgcgcgcgatgggcgagctcgcggagctccccgttcctgggcggcttgttgatgcgttcgatttcgtttcgtacgggttcctgccttgtgttcgatcgtttccgctgcggaatgcgagggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtattcctatactctattatttcataatatttggcaattttgaccggtgattgcttcagtttaaccattaatatcttttaaaatttatgattatgatggatgggatttatatctctatatttaccattaccatgtaacatactttaataatatgttacataatctaatactaaaagtttatttataaaattggaatggccaaactaaaacaatgcgaacttaaaatcaccaagtattatgaaatggagggagcataatatcagtagctcgtaagggaaaaaagggacctaaatgatgccttttgtgataaatataatttcaaatttgcaaaatttttggataggcaacaatactctctcattattgtgttagtattaaggtcaagctacttctatgctaccaaatactccttctgttcctttttttatttcttgtctaggatattgacattatccctaacacacatctttctttgtatgatcatctactcataaaatagttaaaatataactacattattcaattatgaatctatgaatgttatttttatacaccgagttgggaactattctaaactctcgaggggacatcccctcattatctgcatgttatccaaacggttgtgaaaaaaattgaaaaaaaataaacaagatagattaatatgtgataaatcactccacaaacatgcaaggacaaattcaaattctacaagttgcaatgaaaaaattaaatttgaccgtgaatatacattaactagccatagtttaatttttttttgttgtaacttgtagaagttgaatttgaacttgcatgtttgtgaagtaatctatcacatattaatctatcttgtcgatttttttttaaaaaaatcataaccatttagatgacatgcaaaaaacgaggggatgttcccttgagagtttagaatccattctccagtgagttgatgttgagatttgattacacatttcaaaacgacttttatttgttaacgaagggagtaatgtggattcaccatatgtactaatgttattaaggccagataatcctttttttaatcattctaattagatataaacttacgacgaagaacatgaatggataaagtttcagccaacaaatacaaatgtttttcaaagtgctatttctgatgcataatttttgtagcagttatgatttaaatttatacatggataatttgaataatggatcctacttttgtagttgtcacctgacaagccttaagaattattgagggtacaaaaattataactgtgcatttgtttgatattgctctaagactatgcttggcatcatcttttgatgcattggtcaaaccaaagcataatcatgtgatacttcttctgtagtatcgaaggccaccatgg

SEQ ID NO: 56 - DNA, 952 bp, Oryza sativa
  misc_feature (1)..(952): AF139665 3'-regulatory sequence engineered
  misc_feature (1)..(356): 3'-untranslated sequence
  misc_feature (357)..(952): 3'-nontranscribed sequence
aggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctctgatcgatgagtagtccttggtccgagattgtagagccgtgtatgtttcctctcgtcgttgtgctctgtatgcaatcgacggagatgtggtttaacttgtctcacctgctgtgatttcctttcatctgttcttcagatgtaagaaaacgaacagcgccaccgccttttcaaggattaaaagagtaggattcagaactttttttttagagaggagaatcaaaacgcttcctggttatctgaaatctgatgtcagatgccttaaacccttgactgaaagggaagtggttatctgaaatctgatgtcagatgccttaaacccttaactgaaagggaagaggtttgtcagctctgtttcaaactgtatcactgtcatcttgtccgaatctcaaggaaaaaaaatctcttctcatatactccatcttaaaaaaaactcaatttctgaagtttaaattttgtcaaaaaaaatcaacttctactgtcctgcctattttcagcacgtaaaacgagaagttttatcccttaaataccgtttacatatctatcatcattactatttttttttaaataataagggacattttagttgtctttactcctcactaaatttgcattgggatgctaagaatgctctttttatgggacggagggagtattgttccatagcaggttaatgctaaggctgagttcccgaggtggagttcat

SEQ ID NO: 57 - DNA, 18599 bp, Oryza sativa
  misc_feature (1)..(18599): AF141964 5'-regulatory sequence
  misc_feature (1)..(2045): 5'-nontranscribed sequence
  misc_feature (2046)..(2353): Exon
  misc_feature (2354)..(18582): Intron
  misc_feature (2341)..(2341): n is a, c, g, or t
  misc_feature (2377)..(2377): n is a, c, g, or t
  misc_feature (2381)..(2381): n is a, c, g, or t
  misc_feature (2730)..(2731): n is a, c, g, or t
  misc_feature (2733)..(2734): n is a, c, g, or t
  misc_feature (2737)..(2737): n is a, c, g, or t
  misc_feature (2739)..(2742): n is a, c, g, or t
  misc_feature (3144)..(3144): n is a, c, g, or t
  misc_feature (11224)..(11224): n is a, c, g, or t
  misc_feature (11558)..(11558): n is a, c, g, or t
  misc_feature (11574)..(11574): n is a, c, g, or t
  misc_feature (11930)..(11930): n is a, c, g, or t
  misc_feature (18583)..(18599): Exon
aaaacactgattaaagggttgttgaaaggaaaacaccggcaataaaaactagcccaaattaaatttactctaaaaaaatttactcatagcacggtgataaaaatttaagaaaagacgaaaattgtctgcattagccatgcatgtatacatatcactgcaaatgttactgaaagagacgtttcaagtgcatgtgtctctttatcttattaaaataaattctaataatatccactttaggtaatcaaccaagcacggagcactaaaaaaaattatgctggtgcccagcttgtctctttttgaaacaaaatataagtattaaaaaaagtaccgtattatcaaatttggttacatgctaaacataactaaaatactttcgttaattgcatccaaccattttaaaattacttttggtaattgtagccagccatttttaaaattatctgtagttaaaatcgaagtaataaaactcaagattgccaaataaatgcaaacggtaagagtatgaaaaatcagctatgattgttggcgggaagaagtttcgggtaaaagaaaattagatgtgcatagatctggaatgagggaaatagaaaaaaaagcctaattctaatgtggatcgttaaaaatcacaaacacaaacattttttagtaactcgtttcaatatcttttaagtctttcaaatgccactgacatttacaattttaaatcaacacatatgcacatgaatgcgtccttttcatcaaactaaaggtatgatatctgtttatttgtaaatataatactacttttatgcgcacccaaatttctcataagggaaagagcagcgttactagttttagaaagggacaaaacattaacatgagagcgaatcgtttgcatggtgtgcgcaaagcatttattcctaagttggggggggggggccgggggaagttggggaaccgacctgtgcaagttgccatctgctgatgtgcaaacggagcaatttaagggtaatgctcttctctgattttagaatttgatttttcatttgacctgccatgccattcaaactatatatttctataaaacaaacttaaataaatttaattaaaaaaaattaaaacaacttataatataaaacaaaaaaaagtaaaatataacaacacaggatagtgagagacatatcctagtggtataaatctagacgtgtcaagttattatgttttgggcggaggagtatgatatacgtactccctgtgttctataataagtttatttttagcttcttttatttgtcctaaaataaatttatttttaaagtaattattgcatccgagtttatgaaagtatgaaataattatattgagagtagatgaaatagaaaaaatagttgctttggggatttgatacattttttttgggggggtattctagtaattttgattttgtattggtatgtgtggaataggtgaaaaatgaatttattttaagacggaggagtaattcgcatacttttcctttttcaagcaataataaaactgaagtacttgagaaaataattatgagagtcagaggcagtccatgaacacccagagtcccagagtgctcttagcaaattaattatttaccactataaaatttagcaatggttgccaaaagaccaacttgcgtaaacagaaaaaagtactagtatgacaccgaaatgatgccaacgttttactactgctagctaccattgctagtttaaaccgacatttgtggtggtagtgtagatgtgtgtttagctgggagaaagcatctccctacggacacccagagtgctcaataagggaaaggggaagcgttactagttttagaaaaggacaaaaacactgacatgagagggaggcttttgcgcttgcgtgcgcagagcaaaataaaggactgggaaaccgacctatcagcgggggtgtaaaagacggtttggcttgggagcccccgataaatagccccggcaacgcggcgtctgaggtgtacatccgcctcgtcaaatgggggccccccacgcgcgcccatcgatcccctcctcctcctccccaacttctccccaccaccacaccaccacacacacgcacgcacgcacgcacgcctccgttttccccaaccgacgagaggcggagagggaggggagctagggtttttcggggcggggatggcgcggagggggagagtgcagctgaggcggatcgaggacaaggcgagccggcaggtgcggttctccaagaggagggcggggctgttcaagaaggcgttcgagctcgccctgctctgcgacgtggaggtggcgctcctcgtcttctcccccgtcggcaagctctacgagtactcctcctccaggttcgctctctgattccatccccntccntccccccgcctcctcctgttgttagtttgttagttacgatcaaaacccagccgcggccgaatcgagaccccccgccgcggcaggatctgccgattggttccgatcccatttcgttctgctatcccggatcgatcgatgattctccctgctatactgtatcgtaatgggtaagcctagtgcacgccatgtgctcgagactatctcgcagagaccgccacccaccggcgttgcgctgcatgacagccctgtgatttctgattagtaggatcttgttctcttagcctgtacagtagcagcagccagcagcttgtatctagtatatgaagctttgacaccttgtactgttggnngnngancnnnnaaccccccaccgcgggctactggcgctgcattgacatgcccctgtgaatttctgattagtaggatcttgttctcttagcctgtacagtagcagcagccagcagcttgtatctagtatatgaagctttgacaccttgtactgttccgcgcttcgtctccccgacggcgtgggccgcgttgtttttcctcccctggtgtgcttttacacgtgtttcgcatgaggagacaccagccttcgtagaggcggaggcgcgcagcaatacgcgcatcaccctgagagccaccgcagtgtacggcctacggcgagtgaggagtttatcattttctcccaacttttttttcggcatcttgttttttttttctctgagagggagtgatgaaggagtacagttgtgtgtgtttnctttaatttatttcagcgacagggacgaagtcggcttgctctgtagcgaccggcctattctcataaatagtcttttgttatggtattgagtggcatatgttaaataatattatttgatacaactgcttaaagatttttttgtaatggcttatttcttgtattttagtgtacacatcgaacaggactattcttagtgatatagtagtgggataacatatttatctaattaacctttattaatgatatactataaagaacattgataatatatttatatatgtcaagcaacttgattgaaaaacaagcacatcactcacaaagttagcccaattgtgcacaatagtccatttcataccatgatgctaaaaatcgcgcgctctgattgtttgagcgacaacccagaataattcataggtataatattttatatatatattaagtggtttaaaaaccaagattgaaaaatagacctcaataaaaaaaatgccccctaaaatcaactctcaaggagaaccgcgtttggctttggccgataatccacgaacaaatgatgaaatcacatattccatatattcgcattcacttatgaacaaatggcaacttttcttatttcttggtaatgtacgccctacacattttccaacccacatttttctagttttgcaccccctccaccaccaatatggtacaactacagctccaaaatttagctccaggagttaggtctggagtggagttgcctaaatccagttccacaactctagtttattttgtgcgagcttcacccagcttcactcccaattttaatggagctgtaattgtttggctgagctccagctccaagagaagtggagctagagctggagctgtgccaaacaggcccttagcttgtccaaatggtctagattcttatttcagattctacgagtcagaaggtgcataatcaataatcaatgaactggaagccagaagttggataacgtaagcttcagctagatactcaccaattgctttttaggatctgtagctttcttaaatagggcatttcctatctttaatactccatatgtcccaaaatataacgacttttagcctttagaatttgttccaaaatattacaacttctccaccaacattctcttctcaaccaatcacaaccctccaccattcaatttctccacctacattcatttctcaaccaatcacaatcttccaccatttaattctacttattttcttaataaccgtgaccaactctaaaactcattatatcctgtccgtcccaaaataagtttatttttcacgcatctcacgcgtaccaatatctaagaaaaaaaactagaatacattcacttcatcaaattccaatgcagttgttcctcactttatctactcctaatgtattttccccctacttttacaaactctgttgcaataattgctaaaatatgaacttattttgggataaatgggaggggctaaaaatgatcttattctgggacggatggagtagatgcttcttgtagcatatgtttttgaatttaactaccatcaagttccaccacaacatatagaagtatcttgtagtaaccgttattttgctattttgctaatgaaatagactagaggcattttagcttgccttgcacacgagtgacaagtaaactagaacggaaggagaattttattccccctcaatctgaccaaatcgatccaaagccataccagtgtatgattttccttactaaatgtgaggttgatctttcactaacaatgaataaactcctctaaattttgaactaggatgggacaatagacccaaattaacataaaactaggaaatcaatgcggcgatgtttaagtaatgaccatgattgtagacaacaaaataacacaaaattgataaaataactcgtacatgtatgtcatagattatttaatatttgttgggtcgtccccttcatgtgttaaatcatctaggaatttgtcctaacatttgggataaaaaatttcgctaataaatctattgaacatctaatgtacgacaaaagtctctatgacaacccactattagaaattggggcatatagatctccagcaaaccttaacattttattcaagggtttgtccttgaatacatccaggcaaaatgttgaggatttcaatcaaagttcgggccattggatttatttgacgcgtatcttaatggttaacatgtgccctacctcttcttaccttttcttgttatctcactattgaagttgtccatggttactaatactcaaagcctagaggctatacacgcactacctcctgctattccatatcacattctaaccacaatgtctacggttattacttattagctatgtttgcaatgcttcgggcttgcattcaactaagatagcaaaaaaaagtgttaaagtgttaaaaaatccccacaattcccggcacacgagggggtgggggttaaaaatccccttgaatataatttgactaggtatctcttctttgttggcttagaagatttagttgtgtttagtacttcatgaagttatggctatcactacaacttggtcaagtttgatttcttatctagtttgttgccatactaattaaagtgttgcattttgaaatgcacccaaagaagtgaattatgcacacatactagaatcattaacaatcgtttttaaacttgttttatgaatactaatatgtattttatacgcacgtaagacccacataatatgctgaccatatatgtgataaattatgaatgatcttatatcttttatactcccttcgtttaaaactagagggtgtattatgattttacacaatctccaactttgaacattaatttcttttgctataaattatcaactacaaaaacaatatcatatgagagtattttttaaatttgaatctaatgatactacatgtgtagcattaacaacatatttttgtttaattatcagtcaaaattttaaaatggtgattttacagaaaacaacgatgtcatatatatattagagcggatggagtatgttacaaacaaactaactagcatcattactacaaagcttgtccaaggttgaacaaaatcatctcaaaagctctaaccatcatatcattccctcaaaaggcacaaatcattccttgctagactgcttcctatgagtaaattacatcgagcagtaatgtttatcagttatctctatgcacaacctaataatacatcatgcgagtccacaacctttttgcctcctgccaatctatagtattacataattattagaacatagcatatgccattgtttttaaaattcttcctaaatattttaacaaatcaattctaaatatgttagaacatctattataatgtttcaacaatgcacatagtttcatctggtttccttatgcctctccgtagtcggatcattgatttgtcttacgacattaacaatgtgaagtgcaaaggtgctcccagggagaaaacaagtccacataatctagcgtttatgaaagagatgtttatctagttagtaaccaataattctgatattggttttcccatgggtgtgatggatattcattgcaacttacaggcaaataatattgtgcattttcttatttcgaaaagatatcgtacggatgaaagtacatgcatacacttttacacaatattatacaaaattaggtttgcttttcttatcttcagtcttataatataaacatgcaagcatatacaaaatattatctcaaaaatttataatcaacttatgtcaaacatgcaagcaaggatgttgacaagctttaaagtttctttttaaaaaggtcacacttatctgaaatgatcccaattatctcattagtttggatactatattactcctaaggcatgccaaatttataattaacctgacggggttaattttttacattatgattgtagatatcatgaaaacatgtgcttagattattattaacctagaaaaatatgggtttcactattttagttcatagcgtacctgtagttcacacaaaaagtaaatagtattgaggcaactttcaaagtttagatataaagagaagacatatgcaagatattttaaaatataacctttttttggccaaaaaagcactgttattctatgggatcgccaatcacacttaaccatgcaaatatgcaatttgcattgccataagatatttgcactaccatttgtcgcatatttcttacctaatttgcatctctacctttggaccacaaactcttagtctacaactgcacataccactatcaagcatgccagaaggtatgatgtgaggactatcgcaaatcacgtctatagtagaaaaaaaaatcatgccatataaggttcatggagcacatgaaggcaaccatgatatggatgatgatgatgaccattaaatcttctttagggatttggtgcgtactagtagtacgatttaggtattattagtcttgcttcatggaagtacaatttaatgtcaacatcaccatagatatgctaatcaactagagcaaggctgataatattttcaaaataattatgggcacaaatagatgacgaactcttagatgaacttaaggggattgtggaagacaacaattgtcagacgttgatgaagatccatgcatttgtttttatatgtatcttgatcattcatctatactaatataaaagatgctagcggtggaatctatcatcaccaccacccaactacgatgttagaccccgcaaacagtgagtctttccgtattccccaacccctacaagccatagaccctaagacctctagctcaattggcacaacaaaagtaacatgataataatatattagtcaatacaaataacatttttagggacttgaaaatatatacaaggagccattttttcttaaaaggcatgtgcattatgctattatgattgataagcataactgatatgccacacatgaagtatttttcatacggcctaatgatggattaatactaaccaaataaattttgtaaattatgattattaattatataattgtccttattagctatctcgcggaaattcctatgtttcaaaaaatctgcatcaccaaactcttttgagggaccaaatatgcataacatctgacttatacttttgtcatttctccatgtgaaagtgttaagtcaaaagtactataagaacatgtggatttatgtaggccgctatctatctagactctcaatgtgaaattaatcacacaaacaccagaggccatatgggtctctactaccaagctgggtatcacattcacacccagtgagctcacaccttttgtctatctgaatcaaacttttttttaccataatgtgttcttcctactatataccaagtatattgttctaatcttagatggaaaaataaatagaaaaataatctaaaaagatggatcctccaccttcattatgagtaatgaactaggtgctgatacaataaaaagagttgactagattaaccggaatagagtctagtctctagttgcctaagagcaacccatatttatccattccaaagtaaatctactgcctgagaccatctctctcccaagaacatatgcacctgaatgtccagaagaccaaaaccagcccatggtccatggtacactattaggctatataatatccatcgtcccaaatgcacatgtttgagtagaatttttttatttagacctttttaataaataattttaataatagacctcgtcgaaacttatttccaaaaatgagccttttggctatgccgttggaactggcgtggccaaactcttttgccgcaccgttggtcccagcgtggcacctgctacctcgtagctgtcatcgtgttgattaagtgaacgccgacgtaccacttcctgtcacaccaggctcattagtgttgcagctgccaattgccacgcctggctcgatggcatggcagtgtcctctctcaattcttcctcccatcctgtgagaaagtaattttcattgggagatcgatattgttaggatgtattttcattattttgttagccattgtggtttatagatgaacatgacaagtttatagttacaaatttggcacataacgagtaaagatcagatgaagtattagcggtatttgtgaggtattgttagaaaattccacaataacgaatggtttggatggtccattttagaagtgttttgatggacttgatttatgtgttaaagatatgaatggttcaagcattgttgtttttgtctttaatacaatttagatgggtggaaatgactaaatccctcgtaagcaaccatcggttggtgtcgtaggaagagaaatttctagcacacgttgtaacaaccacatccatagaacaaacttgtgatcttgaaacgaatgcaacatacgtcgaccacttcaactcacatgatatgagcatcgccacaaagtatttccttgatccaatccctgcaaccttccattcttggcatgtccataggttcgacatgttgcactttagatcagacccgatcacatgattctacccatataggattggtcgtaaacactaacatgtctacttccataccatcaaactttctatttgcactaatggttcaaccgaaatatacacgcaccccaggatctatctacatgcataatattcacatgcaaatcaaatactcattatagaaccacgtgaccgagcaagcaaacgacttctataaggaaataagcactgcgtgcacgaacctatcatccctacataatcaaaataccctacaaatatcatgtccattctatctcatgtataactcaaattctatacatcgccgagcctggcatggcagttaccacgtgggctacctctccaccaagtccgaacgacgaccgccacggtggaacatgttgccacgccaggaccggtgacgtggcagtattctttgccatgccatatatgtggcgtggccaaaaggtttatttttgaaaataagttttggcgtggtctattattaaaattatttttaaaaaaggtctaaataataaaaaattgtcatgtaatgaaggtttgtactctaataccatgttataccctagctttaatacccgcattattctaaattttaggaaaagcaaactcctgtacattcagaattctacatacactttaatccacacgatatgtaaaatggttaacccaaaaattctatggttagaacgcatgtattttatatgttgatacctacctgttaagactccacccagacttattctaccatcaccacactatcggccaaactagggatggcaatcgggcgcgacgggcacgggtagtgcctacccatacccgtgcccgtgagattatttgtgcccgtgggtatgcctgttactacatgacggtcaaggattgttgcccatgcccatcgcccgcaggcgccttatgcctgcgggcgtgcccgtttacccgccacagcaaaatcagtggaacaaaaagtctacaagcttctaagttcgaatcgaacttaaaacatcaaatattctctgcctcggtgtggtgtctctccttaggcggcgatagaggaagggggagagaaataataagggaaataaaacggaaaccgtagaaaacaaagaaagaggcttatgtattctagtggattttactcctagcctacatgtaagttagatttcgcgggtaaatgggtaaagcgggcatgggtagtgattacccataccatgcccatttacccttcgacatagcttttgacctaataagaaacccatgggtataaaatggagaacaaacccaaccctaatagggtttttacccacgagtaaacgggcaaacgggcacaattgccatccctaggccaaacatgtgtccacaccttcacttacatcgtggaccaacgtgtggtgttgtggttcttagatgtaagatttatttaccaattgccccacgcggatcattagagataaacatattatttttttctttctaccacttattctagccttattctatcatcgctttgggcccatgaagcgaagangatgctcaactacttctctttacacttcttatttctctgtgccttccgcatgcgcttcgtatgtcatggcacttgatctctatttcttcattggaggtttgggatgaacttcgtcgttctttcccaacaaaatggaaagggttgtatcacatcaaatgtcgattggttttccgtcccaaatgagatgggaactagtcaccttaatctcttcatctctatgaaagtctttatgaaaggaatcgaggtctggcccgacccggttcacgtcattccaacaactgacgaggagcaccttagtgtacgatcacgtcgatcaaatacctatatgtcattngtcctagaactatttnggtataatgtatatctatttcgcgagcactcaacattaagtgcctatcgtactatccatataatgccattatgtccttgtttagtttgatttccatgaaatgctatatggagtaatacaaaaaaaaagagcaaatattacaagtatcgcaaatgagattatcttcaaaaaaaaaaatttgaccaaaatttcttagaaataattgtcaaaaagatattggagtgtattgcgttgttggtgtaaaaaactagacaacgatgccaatgaggatgcacttgagtataacaactttaaaaataagtgtattgatctgattgattacttagttcgtaggtgcattcttggacatgatctccnttttttttccattagacacattgattgcgtgaaacttccttacaaattttgcaaaaagtaatttaaagtaaaagagagagtatgcattgttaaaattatagttctaaacgacttcctttatgaatacggagagagtatgcattattattgtactggaggtcatgatctagccatattaaggacattgtttggcatggaataccattattaaactaaaattgtagttacattgaaaaaaagtattgtactggaggtcatgatctagccatattaaggacattgtttggcatggaataccattattaaactaaaattgtagttacattgaaaaaaagtaacaacacataaatagatatagatgatattgtccaaaacatcaaggacaaaaaaaattagtagttttccaaaaaaaaaaagtatggaaccccttgatttagccaaaaacgcacatgggcacctggtttgttcaagaacacacacatagccaagtcacatttagctagttgttgaaatgaatgaattaaacccgctaccaaattaccacaccgacatagtaaactttcaagtttttgcaatcaatgtacccacctgtaatttttttattatccagagtgtaatcactccttatttaagtaggacaaacaaatacattaaacattttttaatgtaactatattgccattagagaagtgctacacttccaaaacaaaaattcttacaaatgttttacaaacgatgatgtaagatattgtgatttaatattgattttctataactttggactaattagatcaaacagttaagaaatttgtttttaagaattttgcatgaactttttagcatgtccaacattgctcttgttgttacaaaggttaaatcttgtttgcagaggcattaataatattacgaagatactgaggttgtgttcgggagtgagtccctagcatgcaaaacgaagcatcgtttagcacatgattaattaagtattagctaaaataaattttaaaaatggattaatatgatttttaaagtaacttttatatagaaatttttttgcaaaaaaacacgctgtttagcagtttgaaaagcgtgtgcgcgaaaaacgagagagatgaattgggaaagtagagataagaactcagcctaaatagtttctttgagttattataacacatgttcaataagttaattgtatacaagttttaattggtgccaaaaactggtataacaatgacaataaaaacgtatgttatttttcactagaacaacattgtaattacatgtgttaacctatacaatgtttggtttgccatgattacgataatattagaaagctcctaacaaatataaaacttgcccattttcttatccaatgatgaaatgaactatttcattatcaaattttaaatgcaaacaaagataatcttaattcgatagaactttcacataagaaaaagtcatatgccaacttcctaatgagtttttgagtaatcccttgcgtagttccatactgtgcttttagccacattgttatcaacatattggttgaattttggggcatgcaaacttatataatgaccctcgaattacactttttgaattgtaggtatgaggtgtttgggggcatattatcaacgaaacatatcctcactaggtagacatgataattacatgattaatttacaaatgactatcataaatatatggaatctcaaaagtccacttgggacacgaaatctaaatgataacatgaaagattgttaatagagacatgttagtccaaattgtttatactttcgctactcatatattaattgaaataaatatttaaatgtgcaaataagagaacatccatgcattgcaatgaatctcaaaaggtgcacagtaattttgaagtctatttaaattctaaacaaaccacaatttaaaaatagccaaactatgtgacaagatatacaaatcattcattaaagaggtggcacactagagccaccactagtcattttatatagaagaaataaatttagattgtccaacaatacctttttttttctaaaaccttattccatcatatatttttttaagaactgaaactccgttgtaatgtagacattttaccattcaaagaaatgctaatatggttgggaattattttatacttgcattagatcatctattataaccttgatgtgagtatccataggattcgtgaattctaattaacaatactgcgaaatatgtaacacttttaacataacattcacgttataatgatgttagttaaaactttattaacatccaaaacaattttttcattggacaaataaatgctcacaaggaaatagatgttatctcaaattggtatgaagataaagaatggttgactaaggaatctattaaaataccttttttttcactgtgtaacttgttggtttgctttacactagtactttattttttgggttcttttgtatttcttatagcaatgtcattcttgtgcttatctcctttgctgtgttttaaacataaacatcatgttttgcattgatttccctgtgttgctaaatatgtgtgttttgatatttatcatgttctattatttaaatatgcatgaattgaagtatactcatatatcctatttccacaatacatactttagtttgttaccaactatgctgaattcggtgctcacattttattatcatcatgttatggtttgatacaatttgacagtttcaagctaaattgggtcaaaaaatgttcatcggaaaattcaacttgggtaaatatttcatcatattgacttcatgctctgatcttcgtggaaatagagaaggatctgctgactgatttagcttttgaacaagtgcaacttggtgcatcgacaagattttgtaggaaatttactacatggggtggccatcatactgaaaataatttatataaaaacttatgtttcatcattattatattcatgtgattgtcttatacataactatttggattcattcaaaccctactctcttttgtaaacttgtattttgcaacaatattatcattggtacttagatgaaacttggttaacaatataatcattagttcttaactttttaagttgactttttgaatatccgtccttgtattgttttagctatgttttattaatagttgtgtttgatcttttttgcggagttggtgccttattgttttgtttacatttctagatatatttgtcctaggattggtgctcttatgcatactcatgatgaggtactcgtttaatgaaaagaaataaagattgtacctcatgttccaaaacaacatattcacaattcattatcatggaagtctcatccaagaaccttttttaactggcgtttcttaaattttgcaaaaactctgactttgaattaagatggataagttcccatgatcaacatagctttcaattctatatagtagttgttattttctaaattagtcaacatctcctaatcttatacattgtactacttacattttgcatgtttatcttcatgatagttcttaaatttctatgacatgtatgtaatttacctttaggttttatgaaaaaggtcgatgacaatgatatgaaattagactaaggaccgatatttcgctgtcaagaattgacatgctaaatcatttgtgccataaaatccaaattgaaaactcacttgtgttcacattattggtcaaaacaaattatatatctatgttctaatatcatgaaaaatgtagaaaaaaagcacttcgaagcttcctatgcaaactgctctcaactagtgccttcagaatattttaaaatagcaactcctacatagcctcattcaaatcaaagtttcaatcacactattgatattactttgagctatttacatactagatgtttatatttgttatattaatagaggttcatgttggtacttctaagaaattgggtcatatttaacatgcttaacctcatcaccttcaaattatgttttagatttgttatgtaaaactagttcatatttattatactaatagagggtacatggaacaaatatgacacatatttaatggttaaaaccttctccattacggaaaccgattcaaatgtgtcatagttggtctcacaacaaaaaaaataggttatactagtcatgaaaatatacaaaatcaagttagaacataatagcgtaatctaggaattaaaagtgcataaaaggtggcttttgataatacgatggtggaggttgggcgcacatatcatgaccggtgttttatggagaaattttttattggggcttggaatatttaaaagcaaaggaatggtttcatctttgaaaatatttttccttccttggtttcttggagacaatcccttaagggtgatctccttttgttgttttgttgtttagattgagtgagggtgataaagatgtagtcttaaactggattaggttgttgtaatcatttatgtttctttttattatcaatatagttttttaacagtggggggcctcccatgttgtgttcctttaaaaaaagtgcataaaaggaatatgtcaggatattatttccatttttagtattactaggcttttgaaaacataaggaacattgaaaagaaaattgaattaagtgcatgtttaatctataaattcaaaatcgaaagagttaatacatattgtatagaagttcaacacaccaaagcaaaacatactactatgactacttgttgaacttcacaatatgctattcacaaatggtagtgagatgcaagtagcactcaaatttagctaaaataaaataaaaagaataagctacaattctagtaacataatggttcttagaagtattttcattactatttgccctacttgagtgataatcatcaaaagtatgcactttatgaaggatatgggtaaagttattgataataataactaaaacatgctatcaagatgcaccaaggactcatggtgttgaagtgtaaaataattatattcctctagtggatcaaaagtatgcactttatgaaggatatgggtaaagttattgattgagttgtttgaaatttcctttggcatatcattactctagaccttgcatgaagaatgcgtaaagtttatatttgagttgtttgccatttcctttagcgtattttgctctaaactttgtaggaaggatgggtaaagttattgtttcgagttgtttgaaatttcctttggcatatcattgcaagaccttgcatgaacaaagggtaaagtttttgttcgagtggtttgccatttcattcaccacattttgctctaaacttatgtaggaaggatatggttggagttatcatttgggttgtttgccatttccttcgatgtctcattgctctaggcttagttgatatcttggtaatttggctcatcttggacttagctatatatttattgtcattggagtcatggctctagtcatcctaggatcgtggttagtggccttgatgatcttacttggttagttgtggtacttggttagttggtaccacattccttgtagaaattcggttaaagaaacattactggagtttataattcccaaatgtaaatcattgtgaattattaattctctatatactctaacgggacaaaagaaaattattcataccaaatcatagatactatttgtacacctaaaaatataagattgtaaagaccatgtatctcatagtcaacaaatcatgttcccaatcatgtatatatgaggacatgcatctaaacttgattttaacaaattttattttaaaaacaaaaaagtaacaaaaaaaaggtgatttatattggtaacacatatatcctctaccctagaggggccactatatcttggttgctatacatttatctccctaagaccacaatattcatccatatgaggggcatccaatgaattatctcaattcctcttgactatggccttattaactgccctacttataaagtctcaatatgtcaacatacttattggcaatcatatggccaacatgttgatcaagtgtttgcgtaggagttgatccaacactagtatcatagttttgtatagaaggtgaaatctatcaccttttacatagaaaatgatcctacagtggaaacctaaaatggtgatttcttgaaatgaaatccattagtatgtttttttaatatgaaaaatcattggtctagtttgtcgttgccagaacaaaagttctgacaattttatattagttcagtgtactataggtgaaactagttcataaaaatatgcattgtcttgatttctgaattttggcaccaaaaataagtgcactaaaggatttaaggcgttctattactaatttagagctttttgtttctggaataaccataaacatgcagtttaaatcagagattcaaaagattgagcataaacacaatagagctctttgtaaatatttcattttgatcataaatctaactcttagtgaattataggagaagacggcatgaactcagcatttttattgtccccattgtttatagttccttttggtatttagccaaagccttgaagttgaatcatatcgactgcctaggaggatattttatctaactcttacctgccttgttttctttttcagcattgaaggtacctatg

SEQ ID NO: 58 - DNA, 1148 bp, Oryza sativa
  misc_feature (1)..(1148): AF141964 3'-regulatory sequence
  misc_feature (1)..(645): 3'-untranslated sequence
  misc_feature (646)..(1148): 3'-nontranscribed sequence
tgagcaggaagcacaggtgtcctgtgcataagtttggcagtgcatgcacctcccaaattaaaaagctaataaaaaaaagagaaaatggtgcatgctctgtttgctgccagtttctcccactgattgatcccaggtagagaaaagagttgccatggcctctggctctgcttgttagatcaagggggggagatggaataaaaggatggggaagtattcaggttcttgtaatgaagacctatgctgtggtgttttagcaatgtttgatatgtgtgctacctgtgtttgactggttgtgttgcttgatgtgtcatctgaccatgatactgaaagcctgataattgcactgacttgtgtatggagtttgtttcaacctattggtatgaatctgtttgattctgtaggaactgtggtttgctgtttgccagatctgattattacgcgtgatacaatctgtccttattatgtctagggacccttatgtctatgtgtgttgtttattcgaatctggcagtgaacaatctgacgaggaactgaaaataactgatagatggttacgttgctgtatctgtaagtgtgagtgagtggatgcttatacaatcttatttttaaataattataagttgtgcctgcgtcgggagtattcataatcgtaattatatcatgttggtgtaattgtgtaagatccatatagcttcttttattatgtgtaatataaagatagcagtactagtacaaactggagtacaagtgatacctgtgctgatgtttccccatgtcctgatttgttggatcaggtaaaagtgattgttgggccggggccggccgcctggtgaacgaatctgcgtatatgcgagggcctggcccataagggaggtaacaataacaacaataacaaagtagaagagctgcatccatatccctcttcctgtgcatgtgcagggtggaaaaaacaaatatgaatttgatgcacgaatgtgcgtcgcatatgattagcacagagtagaagaggggtggttttgtatggatggttgttcttgttcctgaccttggaaatggactcgatgaagagcaatgtcggcgacacactagtgcttcctccgttccacaatgttataacctcagattcgttgtactagattgtatctcat

SEQ ID NO: 59 - DNA, 18600 bp, Oryza sativa
  misc_feature (1)..(18600): AF141964 5'-regulatory sequence engineered
  misc_feature (1)..(18600): n is a, c, g, or t
  misc_feature (2377)..(2377): n is a, c, g, or t
  misc_feature (2381)..(2381): n is a, c, g, or t
  misc_feature (2730)..(2731): n is a, c, g, or t
  misc_feature (2733)..(2734): n is a, c, g, or t
  misc_feature (2737)..(2737): n is a, c, g, or t
  misc_feature (2739)..(2742): n is a, c, g, or t
  misc_feature (3144)..(3144): n is a, c, g, or t
  misc_feature (11224)..(11224): n is a, c, g, or t
  misc_feature (11558)..(11558): n is a, c, g, or t
  misc_feature (11574)..(11574): n is a, c, g, or t
  misc_feature (11930)..(11930): n is a, c, g, or t
aaaacactgattaaagggttgttgaaaggaaaacaccggcaataaaaactagcccaaattaaatttactctaaaaaaatttactcatagcacggtgataaaaatttaagaaaagacgaaaattgtctgcattagccatgcatgtatacatatcactgcaaatgttactgaaagagacgtttcaagtgcatgtgtctctttatcttattaaaataaattctaataatatccactttaggtaatcaaccaagcacggagcactaaaaaaaattatgctggtgcccagcttgtctctttttgaaacaaaatataagtattaaaaaaagtaccgtattatcaaatttggttacatgctaaacataactaaaatactttcgttaattgcatccaaccattttaaaattacttttggtaattgtagccagccatttttaaaattatctgtagttaaaatcgaagtaataaaactcaagattgccaaataaatgcaaacggtaagagtatgaaaaatcagctatgattgttggcgggaagaagtttcgggtaaaagaaaattagatgtgcatagatctggaatgagggaaatagaaaaaaaagcctaattctaatgtggatcgttaaaaatcacaaacacaaacattttttagtaactcgtttcaatatcttttaagtctttcaaatgccactgacatttacaattttaaatcaacacatatgcacatgaatgcgtccttttcatcaaactaaaggtatgatatctgtttatttgtaaatataatactacttttatgcgcacccaaatttctcataagggaaagagcagcgttactagttttagaaagggacaaaacattaacatgagagcgaatcgtttgcatggtgtgcgcaaagcatttattcctaagttggggggggggggccgggggaagttggggaaccgacctgtgcaagttgccatctgctgatgtgcaaacggagcaatttaagggtaatgctcttctctgattttagaatttgatttttcatttgacctgccatgccattcaaactatatatttctataaaacaaacttaaataaatttaattaaaaaaaattaaaacaacttataatataaaacaaaaaaaagtaaaatataacaacacaggatagtgagagacatatcctagtggtataaatctagacgtgtcaagttattatgttttgggcggaggagtatgatatacgtactccctgtgttctataataagtttatttttagcttcttttatttgtcctaaaataaatttatttttaaagtaattattgcatccgagtttatgaaagtatgaaataattatattgagagtagatgaaatagaaaaaatagttgctttggggatttgatacattttttttgggggggtattctagtaattttgattttgtattggtatgtgtggaataggtgaaaaatgaatttattttaagacggaggagtaattcgcatacttttcctttttcaagcaataataaaactgaagtacttgagaaaataattatgagagtcagaggcagtccatgaacacccagagtcccagagtgctcttagcaaattaattatttaccactataaaatttagcaatggttgccaaaagaccaacttgcgtaaacagaaaaaagtactagtatgacaccgaaatgatgccaacgttttactactgctagctaccattgctagtttaaaccgacatttgtggtggtagtgtagatgtgtgtttagctgggagaaagcatctccctacggacacccagagtgctcaataagggaaaggggaagcgttactagttttagaaaaggacaaaaacactgacatgagagggaggcttttgcgcttgcgtgcgcagagcaaaataaaggactgggaaaccgacctatcagcgggggtgtaaaagacggtttggcttgggagcccccgataaatagccccggcaacgcggcgtctgaggtgtacatccgcctcgtcaaatgggggccccccacgcgcgcccatcgatcccctcctcctcctccccaacttctccccaccaccacaccaccacacacacgcacgcacgcacgcacgcctccgttttccccaaccgacgagaggcggagagggaggggagctagggtttttcggggcggggaaggcgcggagggggagagtgcagctgaggcggatcgaggacaaggcgagccggcaggtgcggttctccaagaggagggcggggctgttcaagaaggcgttcgagctcgccctgctctgcgacgtggaggtggcgctcctcgtcttctcccccgtcggcaagctctacgagtactcctcctccaggttcgctctctgattccatccccntccntccccccgcctcctcctgttgttagtttgttagttacgatcaaaacccagccgcggccgaatcgagaccccccgccgcggcaggatctgccgattggttccgatcccatttcgttctgctatcccggatcgatcgatgattctccctgctatactgtatcgtaatgggtaagcctagtgcacgccatgtgctcgagactatctcgcagagaccgccacccaccggcgttgcgctgcatgacagccctgtgatttctgattagtaggatcttgttctcttagcctgtacagtagcagcagccagcagcttgtatctagtatatgaagctttgacaccttgtactgttggnngnngancnnnnaaccccccaccgcgggctactggcgctgcattgacatgcccctgtgaatttctgattagtaggatcttgttctcttagcctgtacagtagcagcagccagcagcttgtatctagtatatgaagctttgacaccttgtactgttccgcgcttcgtctccccgacggcgtgggccgcgttgtttttcctcccctggtgtgcttttacacgtgtttcgcatgaggagacaccagccttcgtagaggcggaggcgcgcagcaatacgcgcatcaccctgagagccaccgcagtgtacggcctacggcgagtgaggagtttatcattttctcccaacttttttttcggcatcttgttttttttttctctgagagggagtgatgaaggagtacagttgtgtgtgtttnctttaatttatttcagcgacagggacgaagtcggcttgctctgtagcgaccggcctattctcataaatagtcttttgttatggtattgagtggcatatgttaaataatattatttgatacaactgcttaaagatttttttgtaatggcttatttcttgtattttagtgtacacatcgaacaggactattcttagtgatatagtagtgggataacatatttatctaattaacctttattaatgatatactataaagaacattgataatatatttatatatgtcaagcaacttgattgaaaaacaagcacatcactcacaaagttagcccaattgtgcacaatagtccatttcataccatgatgctaaaaatcgcgcgctctgattgtttgagcgacaacccagaataattcataggtataatattttatatatatattaagtggtttaaaaaccaagattgaaaaatagacctcaataaaaaaaatgccccctaaaatcaactctcaaggagaaccgcgtttggctttggccgataatccacgaacaaatgatgaaatcacatattccatatattcgcattcacttatgaacaaatggcaacttttcttatttcttggtaatgtacgccctacacattttccaacccacatttttctagttttgcaccccctccaccaccaatatggtacaactacagctccaaaatttagctccaggagttaggtctggagtggagttgcctaaatccagttccacaactctagtttattttgtgcgagcttcacccagcttcactcccaattttaatggagctgtaattgtttggctgagctccagctccaagagaagtggagctagagctggagctgtgccaaacaggcccttagcttgtccaaatggtctagattcttatttcagattctacgagtcagaaggtgcataatcaataatcaatgaactggaagccagaagttggataacgtaagcttcagctagatactcaccaattgctttttaggatctgtagctttcttaaatagggcatttcctatctttaatactccatatgtcccaaaatataacgacttttagcctttagaatttgttccaaaatattacaacttctccaccaacattctcttctcaaccaatcacaaccctccaccattcaatttctccacctacattcatttctcaaccaatcacaatcttccaccatttaattctacttattttcttaataaccgtgaccaactctaaaactcattatatcctgtccgtcccaaaataagtttatttttcacgcatctcacgcgtaccaatatctaagaaaaaaaactagaatacattcacttcatcaaattccaatgcagttgttcctcactttatctactcctaatgtattttccccctacttttacaaactctgttgcaataattgctaaaatatgaacttattttgggataaatgggaggggctaaaaatgatcttattctgggacggatggagtagatgcttcttgtagcatatgtttttgaatttaactaccatcaagttccaccacaacatatagaagtatcttgtagtaaccgttattttgctattttgctaatgaaatagactagaggcattttagcttgccttgcacacgagtgacaagtaaactagaacggaaggagaattttattccccctcaatctgaccaaatcgatccaaagccataccagtgtatgattttccttactaaatgtgaggttgatctttcactaacaatgaataaactcctctaaattttgaactaggatgggacaatagacccaaattaacataaaactaggaaatcaatgcggcgatgtttaagtaatgaccatgattgtagacaacaaaataacacaaaattgataaaataactcgtacatgtatgtcatagattatttaatatttgttgggtcgtccccttcatgtgttaaatcatctaggaatttgtcctaacatttgggataaaaaatttcgctaataaatctattgaacatctaatgtacgacaaaagtctctatgacaacccactattagaaattggggcatatagatctccagcaaaccttaacattttattcaagggtttgtccttgaatacatccaggcaaaatgttgaggatttcaatcaaagttcgggccattggatttatttgacgcgtatcttaatggttaacatgtgccctacctcttcttaccttttcttgttatctcactattgaagttgtccatgcttactaatactcaaagcctagaggctatacacgcactacctcctgctattccatatcacattctaaccacaatgtctacggttattacttattagctatgtttgcaatgcttcgggcttgcattcaactaagatagcaaaaaaaagtgttaaagtgttaaaaaatccccacaattcccggcacacgagggggtgggggttaaaaatccccttgaatataatttgactaggtatctcttctttgttggcttagaagatttagttgtgtttagtacttcatgaagttatggctatcactacaacttggtcaagtttgatttcttatctagtttgttgccatactaattaaagtgttgcattttgaaatgcacccaaagaagtgaattatgcacacatactagaatcattaacaatcgtttttaaacttgttttatgaatactaatatgtattttatacgcacgtaagacccacataatatgctgaccatatatgtgataaattatgaatgatcttatatcttttatactcccttcgtttaaaactagagggtgtattatgattttacacaatctccaactttgaacattaatttcttttgctataaattatcaactacaaaaacaatatcatatgagagtattttttaaatttgaatctaatgatactacatgtgtagcattaacaacatatttttgtttaattatcagtcaaaattttaaaatggtgattttacagaaaacaacgatgtcatatatatattagagcggatggagtatgttacaaacaaactaactagcatcattactacaaagcttgtccaaggttgaacaaaatcatctcaaaagctctaaccatcatatcattccctcaaaaggcacaaatcattccttgctagactgcttcctatgagtaaattacatcgagcagtaatgtttatcagttatctctatgcacaacctaataatacatcatgcgagtccacaacctttttgcctcctgccaatctatagtattacataattattagaacatagcatatgccattgtttttaaaattcttcctaaatattttaacaaatcaattctaaatatgttagaacatctattataatgtttcaacaatgcacatagtttcatctggtttccttatgcctctccgtagtcggatcattgatttgtcttacgacattaacaatgtgaagtgcaaaggtgctcccagggagaaaacaagtccacataatctagcgtttatgaaagagatgtttatctagttagtaaccaataattctgatattggttttcccatgcgtgtgatggatattcattgcaacttacaggcaaataatattgtgcattttcttatttcgaaaagatatcgtacggatgaaagtacatgcatacacttttacacaatattatacaaaattaggtttgcttttcttatcttcagtcttataatataaacatgcaagcatatacaaaatattatctcaaaaatttataatcaacttatgtcaaacatgcaagcaaggatgttgacaagctttaaagtttctttttaaaaaggtcacacttatctgaaatgatcccaattatctcattagtttggatactatattactcctaaggcatgccaaatttataattaacctgacggggttaattttttacattatgattgtagatatcatgaaaacatgtgcttagattattattaacctagaaaaatatgggtttcactattttagttcatagcgtacctgtagttcacacaaaaagtaaatagtattgaggcaactttcaaagtttagatataaagagaagacatatgcaagatattttaaaatataacctttttttggccaaaaaagcactgttattctatgggatcgccaatcacacttaaccatgcaaatatgcaatttgcattgccataagatatttgcactaccatttgtcgcatatttcttacctaatttgcatctctacctttggaccacaaactcttagtctacaactgcacataccactatcaagcatgccagaaggtatgatgtgaggactatcgcaaatcacgtctatagtagaaaaaaaaatcatgccatataaggttcatggagcacatgaaggcaaccatgatatggatgatgatgatgaccattaaatcttctttagggatttggtgcgtactagtagtacgatttaggtattattagtcttgcttcatggaagtacaatttaatgtcaacatcaccatagatatgctaatcaactagagcaaggctgataatattttcaaaataattatgggcacaaatagatgacgaactcttagatgaacttaaggggattgtggaagacaacaattgtcagacgttgatgaagatccatgcatttgtttttatatgtatcttgatcattcatctatactaatataaaagatgctagcggtggaatctatcatcaccaccacccaactacgatgttagaccccgcaaacagtgagtctttccgtattccccaacccctacaagccatagaccctaagacctctagctcaattggcacaacaaaagtaacatgataataatatattagtcaatacaaataacatttttagggacttgaaaatatatacaaggagccattttttcttaaaaggcatgtgcattatgctattatgattgataagcataactgatatgccacacatgaagtatttttcatacggcctaatgatggattaatactaaccaaataaattttgtaaattatgattattaattatataattgtccttattagctatctcgcggaaattcctatgtttcaaaaaatctgcatcaccaaactcttttgagggaccaaatatgcataacatctgacttatacttttgtcatttctccatgtgaaagtgttaagtcaaaagtactataagaacatgtggatttatgtaggccgctatctatctagactctcaatgtgaaattaatcacacaaacaccagaggccatatgggtctctactaccaagctgggtatcacattcacacccagtgagctcacaccttttgtctatctgaatcaaacttttttttaccataatgtgttcttcctactatataccaagtatattgttctaatcttagatggaaaaataaatagaaaaataatctaaaaagatggatcctccaccttcattatgagtaatgaactaggtgctgatacaataaaaagagttgactagattaaccggaatagagtctagtctctagttgcctaagagcaacccatatttatccattccaaagtaaatctactgcctgagaccatctctctcccaagaacatatgcacctgaatgtccagaagaccaaaaccagcccatgctgcatggtacactattaggctatataatatccatcgtcccaaatgcacatgtttgagtagaatttttttatttagacctttttaataaataattttaataatagacctcgtcgaaacttatttccaaaaatgagccttttggctatgccgttggaactggcgtggccaaactcttttgccgcaccgttggtcccagcgtggcacctgctacctcgtagctgtcatcgtgttgattaagtgaacgccgacgtaccacttcctgtcacaccaggctcattagtgttgcagctgccaattgccacgcctggctcgatggcatggcagtgtcctctctcaattcttcctcccatcctgtgagaaagtaattttcattgggagatcgatattgttaggatgtattttcattattttgttagccattgtggtttatagatgaacatgacaagtttatagttacaaatttggcacataacgagtaaagatcagatgaagtattagcggtatttgtgaggtattgttagaaaattccacaataacgaatggtttggatggtccattttagaagtgttttgatggacttgatttatgtgttaaagatatgaatggttcaagcattgttgtttttgtctttaatacaatttagatgggtggaaatgactaaatccctcgtaagcaaccatcggttggtgtcgtaggaagagaaatttctagcacacgttgtaacaaccacatccatagaacaaacttgtgatcttgaaacgaatgcaacatacgtcgaccacttcaactcacatgatatgagcatcgccacaaagtatttccttgatccaatccctgcaaccttccattcttggcatgtccataggttcgacatgttgcactttagatcagacccgatcacatgattctacccatataggattggtcgtaaacactaacatgtctacttccataccatcaaactttctatttgcactaatggttcaaccgaaatatacacgcaccccaggatctatctacatgcataatattcacatgcaaatcaaatactcattatagaaccacgtgaccgagcaagcaaacgacttctataaggaaataagcactgcgtgcacgaacctatcatccctacataatcaaaataccctacaaatatcatgtccattctatctcatgtataactcaaattctatacatcgccgagcctggcatggcagttaccacgtgggctacctctccaccaagtccgaacgacgaccgccacggtggaacatgttgccacgccaggaccggtgacgtggcagtattctttgccatgccatatatgtggcgtggccaaaaggtttatttttgaaaataagttttggcgtggtctattattaaaattatttttaaaaaaggtctaaataataaaaaattgtcatgtaatgaaggtttgtactctaataccatgttataccctagctttaatacccgcattattctaaattttaggaaaagcaaactcctgtacattcagaattctacatacactttaatccacacgatatgtaaaatggttaacccaaaaattctatggttagaacgcatgtattttatatgttgatacctacctgttaagactccacccagacttattctaccatcaccacactatcggccaaactagggatggcaatcgggcgcgacgggcacgggtagtgcctacccatacccgtgcccgtgagattatttgtgcccgtgggtatgcctgttactacatgacggtcaaggattgttgcccatgcccatcgcccgcaggcgccttatgcctgcgggcgtgcccgtttacccgccacagcaaaatcagtggaacaaaaagtctacaagcttctaagttcgaatcgaacttaaaacatcaaatattctctgcctcggtgtggtgtctctccttaggcggcgatagaggaagggggagagaaataataagggaaataaaacggaaaccgtagaaaacaaagaaagaggcttatgtattctagtggattttactcctagcctacatgtaagttagatttcgcgggtaaatgggtaaagcgggcatgggtagtgattacccataccatgcccatttacccttcgacatagcttttgacctaataagaaaccgatgggtataaaatggagaacaaacccaaccctaatagggtttttacccacgagtaaacgggcaaacgggcacaattgccatccctaggccaaacatgtgtccacaccttcacttacatcgtggaccaacgtgtggtgttgtggttcttagatgtaagatttatttaccaattgccccacgcggatcattagagataaacatattatttttttctttctaccacttattctagccttattctatcatcgctttgggcccatgaagcgaagangatgctcaactacttctctttacacttcttatttctctgtgccttccgcatgcgcttcgtatgtcatggcacttgatctctatttcttcattggaggtttgggatgaacttcgtcgttctttcccaacaaaatggaaagggttgtatcacatcaaatgtcgattggttttccgtcccaaatgagatgggaactagtcaccttaatctcttcatctctatgaaagtctttatgaaaggaatcgaggtctggcccgacccggttcacgtcattccaacaactgacgaggagcaccttagtgtacgatcacgtcgatcaaatacctatatgtcattngtcctagaactatttnggtataatgtatatctatttcgcgagcactcaacattaagtgcctatcgtactatccatataatgccattatgtccttgtttagtttgatttccatgaaatgctatatggagtaatacaaaaaaaaagagcaaatattacaagtatcgcaaatgagattatcttcaaaaaaaaaaatttgaccaaaatttcttagaaataattgtcaaaaagatattggagtgtattgcgttgttggtgtaaaaaactagacaacgatgccaatgaggatgcacttgagtataacaactttaaaaataagtgtattgatctgattgattacttagttcgtaggtgcattcttggacatgatctccnttttttttccattagacacattgattgcgtgaaacttccttacaaattttgcaaaaagtaatttaaagtaaaagagagagtatgcattgttaaaattatagttctaaacgacttcctttatgaatacggagagagtatgcattattattgtactggaggtcatgatctagccatattaaggacattgtttggcatggaataccattattaaactaaaattgtagttacattgaaaaaaagtattgtactggaggtcatgatctagccatattaaggacattgtttggcatggaataccattattaaactaaaattgtagttacattgaaaaaaagtaacaacacataaatagatatagatgatattgtccaaaacatcaaggacaaaaaaaattagtagttttccaaaaaaaaaaagtatggaaccccttgatttagccaaaaacgcacatgggcacctggtttgttcaagaacacacacatagccaagtcacatttagctagttgttgaaatgaatgaattaaacccgctaccaaattaccacaccgacatagtaaactttcaagtttttgcaatcaatgtacccacctgtaatttttttattatccagagtgtaatcactccttatttaagtaggacaaacaaatacattaaacattttttaatgtaactatattgccattagagaagtgctacacttccaaaacaaaaattcttacaaatgttttacaaacgatgatgtaagatattgtgatttaatattgattttctataactttggactaattagatcaaacagttaagaaatttgtttttaagaattttgcatgaactttttagcatgtccaacattgctcttgttgttacaaaggttaaatcttgtttgcagaggcattaataatattacgaagatactgaggttgtgttcgggagtgagtccctagcatgcaaaacgaagcatcgtttagcacatgattaattaagtattagctaaaataaattttaaaaatggattaatatgatttttaaagtaacttttatatagaaatttttttgcaaaaaaacacgctgtttagcagtttgaaaagcgtgtgcgcgaaaaacgagagagatgaattgggaaagtagagataagaactcagcctaaatagtttctttgagttattataacacatgttcaataagttaattgtatacaagttttaattggtgccaaaaactggtataacaatgacaataaaaacgtatgttatttttcactagaacaacattgtaattacatgtgttaacctatacaatgtttggtttgccatgattacgataatattagaaagctcctaacaaatataaaacttgcccattttcttatccaatgatgaaatgaactatttcattatcaaattttaaatgcaaacaaagataatcttaattcgatagaactttcacataagaaaaagtcatatgccaacttcctaatgagtttttgagtaatcccttgcgtagttccatactgtgcttttagccacattgttatcaacatattggttgaattttggggcatgcaaacttatataatgaccctcgaattacactttttgaattgtaggtatgaggtgtttgggggcatattatcaacgaaacatatcctcactaggtagacatgataattacatgattaatttacaaatgactatcataaatatatggaatctcaaaagtccacttgggacacgaaatctaaatgataacatgaaagattgttaatagagacatgttagtccaaattgtttatactttcgctactcatatattaattgaaataaatatttaaatgtgcaaataagagaacatccatgcattgcaatgaatctcaaaaggtgcacagtaattttgaagtctatttaaattctaaacaaaccacaatttaaaaatagccaaactatgtgacaagatatacaaatcattcattaaagaggtggcacactagagccaccactagtcattttatatagaagaaataaatttagattgtccaacaatacctttttttttctaaaaccttattccatcatatatttttttaagaactgaaactccgttgtaatgtagacattttaccattcaaagaaatgctaatatggttgggaattattttatacttgcattagatcatctattataaccttgatgtgagtatccataggattcgtgaattctaattaacaatactgcgaaatatgtaacacttttaacataacattcacgttataatgatgttagttaaaactttattaacatccaaaacaattttttcattggacaaataaatgctcacaaggaaatagatgttatctcaaattggtatgaagataaagaatggttgactaaggaatctattaaaataccttttttttcactgtgtaacttgttggtttgctttacactagtactttattttttgggttcttttgtatttcttatagcaatgtcattcttgtgcttatctcctttgctgtgttttaaacataaacatcatgttttgcattgatttccctgtgttgctaaatatgtgtgttttgatatttatcatgttctattatttaaatatgcatgaattgaagtatactcatatatcctatttccacaatacatactttagtttgttaccaactatgctgaattcggtgctcacattttattatcatcatgttatggtttgatacaatttgacagtttcaagctaaattgggtcaaaaaatgttcatcggaaaattcaacttgggtaaatatttcatcatattgacttcatgctctgatcttcgtggaaatagagaaggatctgctgactgatttagcttttgaacaagtgcaacttggtgcatcgacaagattttgtaggaaatttactacatggggtggccatcatactgaaaataatttatataaaaacttatgtttcatcattattatattcatgtgattgtcttatacataactatttggattcattcaaaccctactctcttttgtaaacttgtattttgcaacaatattatcattggtacttagatgaaacttggttaacaatataatcattagttcttaactttttaagttgactttttgaatatccgtccttgtattgttttagctatgttttattaatagttgtgtttgatcttttttgcggagttggtgccttattgttttgtttacatttctagatatatttgtcctaggattggtgctcttatgcatactcatgatgaggtactcgtttaatgaaaagaaataaagattgtacctcatgttccaaaacaacatattcacaattcattatcatggaagtctcatccaagaaccttttttaactggcgtttcttaaattttgcaaaaactctgactttgaattaagatggataagttcccatgatcaacatagctttcaattctatatagtagttgttattttctaaattagtcaacatctcctaatcttatacattgtactacttacattttgcatgtttatcttcatgatagttcttaaatttctatgacatgtatgtaatttacctttaggttttatgaaaaaggtcgatgacaatgatatgaaattagactaaggaccgatatttcgctgtcaagaattgacatgctaaatcatttgtgccataaaatccaaattgaaaactcacttgtgttcacattattggtcaaaacaaattatatatctatgttctaatatcatgaaaaatgtagaaaaaaagcacttcgaagcttcctatgcaaactgctctcaactagtgccttcagaatattttaaaatagcaactcctacatagcctcattcaaatcaaagtttcaatcacactattgatattactttgagctatttacatactagatgtttatatttgttatattaatagaggttcatgttggtacttctaagaaattgggtcatatttaacatgcttaacctcatcaccttcaaattatgttttagatttgttatgtaaaactagttcatatttattatactaatagagggtacatggaacaaatatgacacatatttaatggttaaaaccttctccattacggaaaccgattcaaatgtgtcatagttggtctcacaacaaaaaaaataggttatactagtcatgaaaatatacaaaatcaagttagaacataatagcgtaatctaggaattaaaagtgcataaaaggtggcttttgataatacgatggtggaggttgggcgcacatatcatgaccggtgttttatggagaaattttttattggggcttggaatatttaaaagcaaaggaatggtttcatctttgaaaatatttttccttccttggtttcttggagacaatcccttaagggtgatctccttttgttgttttgttgtttagattgagtgagggtgataaagatgtagtcttaaactggattaggttgttgtaatcatttatgtttctttttattatcaatatagttttttaacagtggggggcctcccatgttgtgttcctttaaaaaaagtgcataaaaggaatatgtcaggatattatttccatttttagtattactaggcttttgaaaacataaggaacattgaaaagaaaattgaattaagtgcatgtttaatctataaattcaaaatcgaaagagttaatacatattgtatagaagttcaacacaccaaagcaaaacatactactatgactacttgttgaacttcacaatatgctattcacaaatggtagtgagatgcaagtagcactcaaatttagctaaaataaaataaaaagaataagctacaattctagtaacataatggttcttagaagtattttcattactatttgccctacttgagtgataatcatcaaaagtatgcactttatgaaggatatgggtaaagttattgataataataactaaaacatgctatcaagatgcaccaaggactcatggtgttgaagtgtaaaataattatattcctctagtggatcaaaagtatgcactttatgaaggatatgggtaaagttattgattgagttgtttgaaatttcctttggcatatcattactctagaccttgcatgaagaatgcgtaaagtttatatttgagttgtttgccatttcctttagcgtattttgctctaaactttgtaggaaggatgggtaaagttattgtttcgagttgtttgaaatttcctttggcatatcattgcaagaccttgcatgaacaaagggtaaagtttttgttcgagtggtttgccatttcattcaccacattttgctctaaacttatgtaggaaggatatggttggagttatcatttgggttgtttgccatttccttcgatgtctcattgctctaggcttagttgatatcttggtaatttggctcatcttggacttagctatatatttattgtcattggagtcatggctctagtcatcctaggatcgtggttagtggccttgatgatcttacttggttagttgtggtacttggttagttggtaccacattccttgtagaaattcggttaaagaaacattactggagtttataattcccaaatgtaaatcattgtgaattattaattctctatatactctaacgggacaaaagaaaattattcataccaaatcatagatactatttgtacacctaaaaatataagattgtaaagaccatgtatctcatagtcaacaaatcatgttcccaatcatgtatatatgaggacatgcatctaaacttgattttaacaaattttattttaaaaacaaaaaagtaacaaaaaaaaggtgatttatattggtaacacatatatcctctaccctagaggggccactatatcttggttgctatacatttatctccctaagaccacaatattcatccatatgaggggcatccaatgaattatctcaattcctcttgactatggccttattaactgccctacttataaagtctcaatatgtcaacatacttattggcaatcatatggccaacatgttgatcaagtgtttgcgtaggagttgatccaacactagtatcatagttttgtatagaaggtgaaatctatcaccttttacatagaaaatgatcctacagtggaaacctaaaatggtgatttcttgaaatgaaatccattagtatgtttttttaatatgaaaaatcattggtctagtttgtcgttgccagaacaaaagttctgacaattttatattagttcagtgtactataggtgaaactagttcataaaaatatgcattgtcttgatttctgaattttggcaccaaaaataagtgcactaaaggatttaaggcgttctattactaatttagagctttttgtttctggaataaccataaacatgcagtttaaatcagagattcaaaagattgagcataaacacaatagagctctttgtaaatatttcattttgatcataaatctaactcttagtgaattataggagaagacggcatgaactcagcatttttattgtccccattgtttatagttccttttggtatttagccaaagccttgaagttgaatcatatcgactgcctaggaggatattttatctaactcttacctgccttgttttctttttcagcattgaaggccaccatgg

SEQ ID NO: 60 - DNA, 1143 bp, Oryza sativa
  misc_feature (1)..(1143): AF141964 3'-regulatory sequence engineered
  misc_feature (1)..(640): 3'-untranslated sequence
  misc_feature (641)..(1143): 3'-nontranscribed sequence
aggaagcacaggtgtcctgtgcataagtttggcagtgcatgcacctcccaaattaaaaagctaataaaaaaaagagaaaatggtgcatgctctgtttgctgccagtttctcccactgattgatcccaggtagagaaaagagttgccttggcctctggctctgcttgttagatcaagggggggagatggaataaaaggatggggaagtattcaggttcttgtaatgaagacctatgctgtggtgttttagcaatgtttgatatgtgtgctacctgtgtttgactggttgtgttgcttgatgtgtcatctgaccatgatactgaaagcctgataattgcactgacttgtgtatggagtttgtttcaacctattggtatgaatctgtttgattctgtaggaactgtggtttgctgtttgccagatctgattattacgcgtgatacaatctgtccttattatgtctagggacccttatgtctatgtgtgttgtttattcgaatctggcagtgaacaatctgacgaggaactgaaaataactgatagatggttacgttgctgtatctgtaagtgtgagtgagtggatgcttatacaatcttatttttaaataattataagttgtgcctgcgtcgggagtattcataatcgtaattatatcatgttggtgtaattgtgtaagatccatatagcttcttttattatgtgtaatataaagatagcagtactagtacaaactggagtacaagtgatacctgtgctgatgtttccccatgtcctgatttgttggatcaggtaaaagtgattgttgggccggggccggccgcctggtgaacgaatctgcgtatatgcgagggcctggcccataagggaggtaacaataacaacaataacaaagtagaagagctgcatccatatccctcttcctgtgcatgtgcagggtggaaaaaacaaatatgaatttgatgcacgaatgtgcgtcgcatatgattagcacagagtagaagaggggtggttttgtatggatggttgttcttgttcctgaccttggaaatggactcgatgaagagcaatgtcggcgacacactagtgcttcctccgttccacaatgttataacctcagattcgttgtactagattgtatctcat

SEQ ID NO: 61 - DNA, 8992 bp, Oryza sativa
  misc_feature (1)..(8992): AF141965 5'-regulatory sequence
  misc_feature (1)..(2017): 5'-nontranscribed sequence
  misc_feature (2018)..(2322): Exon
  misc_feature (2323)..(8976): Intron
  misc_feature (8977)..(8992): Exon
tgtttctcgattaggctacaagttaacatcagatttatgggttcaaatatagtactagtttacatcgcatttaacagtagaattatttctcaaaacaaaattgtagtatctgatttttggtaatgagtttgtagcatggaatgatgctgtgttctgatttgcacaagaatggcatgcgtactatgcatgtcaagggctcaattgtgatgatttgtaccccttttttttgtgaaattcagatagattgctacatgctttcctcttttggtttctgcatataatcctggtttcttctagaggagttctaatttggttgtcccatgttgtaaataaaattatgattgtaagtacaaatggctataaaattgatacggcattcacaatattatattgagatatttctttttatataagattagcacacaacttttcattcgagtactgctctcattgagatggccagatactattttctgattgaaaagtccacgcccatgcatatggttttaattaaaaggcacatgtgttttcgtgagaatgtgaaatcaaagcatgtcgctattgccatgattatcctaagatttcacgctcttgcccgcaaaaactttaacgggctactcacagggaaaatagttggcagatagccacgctttaacgtacgattgccatatatatgaaaaacaaaacaagccatacgcctagccacttgcttttgacatatcccactctggtgtctggacaaggatagaaacaaaccccaccaccattcatgggccgtttgatttatttatttctagcaatggtagattcttttattgggtcggaaaacggatgtgagccactcttgtggtacatgttaacacaactttaactagttcattttagtgatgagattagggatttttcgctggtctccgtctcttcgagtatgtgttaggggcacatccacggttaaatcgagaggttcactccatagaatcaataatatgtacattaggacatactccctccgtcctgcaataaatgaatctagctaggactgaatgtggatgtgacacgttctacatccaagactagctggattggtttttaatgggcgaaggaagtaataagaaccaaaatggttaaagcttgaccatcaatctaagcataagagcaagtataatagtaggctataagccggctaaatgctgaggtggatgagagaagcgggctgtagacttacagccggcttgagcataagaaccaagaaactctgtgagagagacaaatgggtcctatattaattgtaaagagctaactattatataggtaggctgagagaaagctacaaagaaccttatagccaataggtcggctgtattattagccttgctctaatgcagttgccagaaatgtcctaggcgggaatacctggggtgcaaatgggtgaattctttcccaccaattggcgcggtccctctgatctctctttccccataggcggaggccagctaagcggaaaggggccacctggtggtagtgttggggcggggcctcgcccacttgttcctacgcccctttccgcgcgaggaggtgggacgagagacgacggcgatccacggccaatggcgattgccggtctcggtcggtcgcactcgcgctcgcgcgcgggcgcctcgtgggtcgcgggtttcccaggacgggaagtcgctcgcgcggtcgccttctttatttggctacctcctcctcctctcccctccccacccatctcgccctcgtctcgtctcgtctctccactcccccacctcccatccgctactgctagtactactactacccggcctctcgccttctcgcgcggccgcgatttccgttcgcaaatccgcacccacggcggcgcgaggtcgccgtcgtcgtcgagccatttcgggtgagagggggggtctccggtttttctcagatctgtccacttttgtccagttttgatctggtgatttaatatactatttttcacttctggtggtttgcggcgacgcgtgtgcaggggggtagtttataagggcttgcgcgaggagggggaggagtagcgggtagcggcggctcgagtcgagtcgtcgtcgtcgtcggcggcggcggtcgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccaggtataccttcttctcgttctcggcaagttctcgccggaaattattctctcgctcgtttcgccctcgtcgtgctgctgcatcaaatgcaaatgcgatttcattctctctctctctctctgtggtaatcgggtgatttttgtggtttggggggtttgaggattcggctgttgggattgcttgttcgtcagagtttgaattcctgcccttaattccgtcgaacaaaaatgggttctctgttcggatttggcacctgcggatttggccaccgctgctgcgacgacgaagacgacggcgacggcgaccgccggccacacacactactagtagcctactagttcgtcttgcttctcacttgctattattgttattattggaagctgtgaactcctgtagaagttgaccccttctctccccctaaatatctgtacggccctggagaccggatggatatgcccacacctcagcactctctcacagtcaccaccagttgcctgtagtatctcttcttcattcatcttcttcttcctctcacatgttaacaactgttccatggagcatgtccacgagctctggattgattctctggcgcgtctctgtgcatcttccttccccattcgtcgattcttgttctcgatccgcgggaaaattgacgattaaaggaggctcctgacctctgaataaaatcaaggacaaaaacgtacaagaaggcagaggtaataaacccaagatagccaatatacaaagaaaaaccaaagtaaatggcagccaatgggaggaaggaggccggccggcgtgcgtggccagtaattgcggggtaggaagaaggctgcgagcctgcgagcgtgcgagactacaaatggagaaacaagctaatgtgacatccggtcagtgagatgagagatcattgggcgcctacctgcaccctctctctctctctctcgatccacaccactgcactgctcccctctcgatcgtacactggctgatgagctagccaagttgatttctctcgcaaaacgtaccacggattggtcgcatcagctccgttcgtcgagggtatggtgtgggggtatctttccatcatacacagtatgacgttggccacagtacatagcatgcgatatggctgtttctgaatattttttcagttttcagcaggtccgaatttgttaggtggaaccgtgatttatatatttctcccctcttccttgtggatatagtactcgtattgtgtatcttactcctagttctcttgcacccactccagctggagagtggagagagtggagagtacgtaccttatctggcgcacactgtactataatccttatattttggtgatcaggtgcaccgtttattatagattaatcatcatctcttagacatggcttgttgcaccttaatatccatctctttatcaggcttatatgtctacggcagtgaaaaagcgttgccagttaattcattgtcgtgcatgtagtttccaaaccatagtctagggaacactcaatgttgttccatgatattaagtgatgttaagtactccataacttaattagtactccatgccaatactcgacaacataatatttccatcacacttcatatatatgtatgctctccctctttctcaattaggaagatctatctagaaaattcttgagtttgcaagctatgatatgcaacgaactttcttctaatgtaagtgcaaaactatggattgtcattcattacttacgttacttcttaataaacattatcaagaagctagattgtagagcatgtaaagctgagtggaaaaggagttttggtaagcatgtgattgacatgtcttataggtcgtcgattgatctgcccaaacaacagtacaaatgaagttaattctactgtgaatagcatgtgataactcgcaatccgtagaatgctttggctttaaaacaataattttaagagtgtgagcaatgcttatgttacttcatcagattatcgtgtgccttaattcttatctgttgatcatatttagtactcctcctacccataaatatatgaacacttgaagcatttaaaatttatccacaaatatgatgattattcctagagtactactgatccctcttcccaaaataagtgaccaatttggatgtaaaatttgtttcaagataagtgatcacattacagtgctacttgtctattaatcacctcttgttcaaacttcttatcttacctcaactaccctcccacttctaaacatccctcatttaggtcatttgcctttcctcattatttggctcatatataagtgataaagtagcttattcatttattttagaacagatcgatggagtacttattacaacaatcacccgtcattcaaatttctttctaacttacactcaaccaccgtcccacctccatctctctatcttctcctccaactctctctcttttaatgaggggcaccaaaatattttcttctcaactttaatctctactaaacaatttggcatgtgtatatttgttaatggagggagtattttctaagttctaagtacttgatatatatcgtttaaccagaaatctatacctatgtgaaaaaaatacattgtccatagatcgatctttcatgagtatattactgaatcatgccaaatttggccaatgttacatattaattatgatcttaaagtttgttctgaaattactttgccttgaatcttccaagcaagtatatatatacgtgtaggcaccacacttctcatggtcaaatttagatatttatcaacctaattagtcagtccatatatagagagttaatgcaactagctagttgctttgtctaatgtgagatcttttgtacgtgaactgtaaacattatatatacaacctccatcctatattacttgtcgctttgagtttttatttgtaatgtttgatcattcgtcttattcaaaaattttttacaattgttatttattttatttgtgatttgctttattatcaaaagtattttaaatatgacttatcttttttatatttgcactaatttttcaaataaaacaaagggtcaaacgttgtaacgaaaaagtcaaagcgacatctattatgagacggaggtagtatgatcggtgtgctgtctttagtcctgtttaagatacttaatttctctgaaatacaattgctcataattacagtgttgttgtcagttttgtcttcttttccaaatactttatttgaaatatggataaatcaaacttaccttttaccctaataaactacactatacatactaatcttaataacatttatgcataacatttatggtttttgttcattcttttcaaatccgttccattctgggcagaatggggcaatgcaagtactgtcacaaagaacaaagaacagatggtgcagccggatatgcatatatatataccagctgaatttttggccgtttcaggaaaacttcaatttaaaatcaatgttggtactatcaaattaatagctgcaaagtctccactaggtctagcaagaaagtagcagctcaatggtagtaataacttcatatgtttatcgaacagatattagctttctttaaaagtccattaccaaacaaggcttatctaggggcatagtacccccatagacccatatgtaggagtaacaaagagaaaatgattaattacaaatattttaatgggcttgtttggcagggctccaactctaagtactagctaaattctgttctacctctctagttcattttataaaagcactctagcattctcctctctctttgtaggtggagctgaaaccgtttggttgggctctagctcaaggagaggtggagttggagctttgccgtatgggcccaatgtatataaaaaatatctataatttggttatagagtatttgtatttcaatgggaaaaaggtatatgtgttaatagtattatactcttctcataaaaatgagtgtgaaactaacttttgtaataatccttactattagttagctgagctcgaactattctttagtgtacaggcaacacgccccaattctacaagtgctgcaaccaaagctttcaatactggttttgccggaaatacccgtaccgcttgctggttgttacttcttccgtttcataatgtaagtcattctaacattgcccacattcatacaaatgttaatgaatctagacataaacatatgactagattcattaacatctatatgaatgtgggcaatgctagaatgacttacgttatgaaatggagggagtattagacaaatgttcaaatctaaaattttgaactcactgtggttcagtaacctgcaggcagagaaaaacagcatgattgaaagcacagttttgcataaacaatacatcgcaagtagatgaaaactattaaaacataatcatcaataatgatctgaccagtctaaaaaaatcaataatgatacgcatcaatagatataagtccatcatgaacaatcataatgcaataatccatcacaaaacccctacatagggcataccacaatattattccttctcaaattgtaattcaaggtataacacaatttcacagcacacataaatatcttattgatcttttctctctttccattagagatgtacctacagataacccttcaaagtgaagataaattcatatataaattttcaaatatgtttttctagattttcaaattataaaataaactgtcccaggcagttactagacgttgagatttctaacatggttgtgccatcaatggctgtttaatttctgtacatattacataacatatagtagggttgtcaatgagctgaacttgagcacatggcacatcaatttcgttttcaagttgaatgaatgatctaaattgaccttgagtgaacctgagttggtgccaacaaccgatgttgaaggtatgctcttgctaaaatttaattgaaaacttgagctttagcccgataaggtcacacgaactctatttatgcatgtctgaatgtgtttcatgcaaaaaagaaaaggcatggccaataatttcgaatccataaggcttgttagcttacatgtgttatccttcaatgaaaattatattctatattggacaaggtttcgattcttgttggtttatatggttgaaacttttatgcttggaacaattcctacctgatgaatcttgttattattcccaaagaatagccaaatacaatatatttgtttctactatataacaactacattttggcaagtcaataatttttttttgcgaggaggctagtcaataattaagtaggcacactcctatgcacgccaatcagattatgttgattcagaaacatgcatgcgcactgcacataagattgctcattgaggtagttgcattatttatttagctaagatattgccagcatggcaatgaagcagatatgatgaaaatggaggatccagaatatatatcctcagcttttttttccaattatcaaaaagtttaaaccatcactaggaagagtgaagctcttgcattgttcatttaattaggtggacaacagaaggaacagttcagtttcataatatatagcggtcaagaaaaagtttcatattatatataatacatgtgattttgcgacttgatacatttatcgtagtatccattattcttgttaaactgagcctgccctgcctatggaatgattacctgaaatattattttagtggaactcagttatgccttttatattttattaaaaagatagaatttgagtttgtgtcccaattttttgttaccaggaaagattctaaaaaaactcaaaagatgttgactatctaatctttttgaacaagatagatacttagaaccaaatttacacaaagaataaagcattttaaaatgtaatacaagtagatgtatttcctagtctggtttgaactgcatacaaaaacaaaattgctccaaaggatgtctgtcatactggcaaatgtagacatgcttcttgaaaaagttggctcaaagatggtcaattatgcaatgtttttttttcaaataaatatatattttttaacatatgtactgaaattgaacgttttgtgatatacacagaacatgcaccagtttaacttgcagtcctgaattttattgatgtttaagtgcttgcgttcacttattggtaactatagaacgtccatgcatgtgctatcgtgtgtacagcttgggatgtaacatctgaattatgatataataaatatctaggaaggtaacaaaatgttcctcgctagtgctggtgttgatatattttcagagaaagctggaagcgcaactgtcaaatcaacagccgcctattggcattgaaacatacatatctacctctcgttgtttctacttttttttggcaagaatttggttggatatagttggccataggcctgtagccaccactgtttgtagcatcgcaatatgcacagacaaacatttgagctgctgagctagcagagctagctagtttattgtagcaggttggaacaagcacagctagctcaagtcatgcatgcactaataaattagagtatgtatgttttttgccccagaacgattatatcatcgatcttctgatttttagtttgctccttgtgtctgttctgcagcctacagaaaaccatc

SEQ ID NO: 62 - DNA, 822 bp, Oryza sativa
  misc_feature (1)..(822): AF141965 5'-regulatory sequence
  misc_feature (1)..(822): AF141965 3'-regulatory sequence
  misc_feature (1)..(311): 3'-untranslated sequence
  misc_feature (312)..(822): 3'-nontranscribed sequence
tgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgcttccagctgcctctaccctcatatctcacctgcctgtgtgtttgtgtaaattgagcttgcgaaagaggaaggtagatgctgttaatttatgggagtggaagctaaatgttgtactactggagtactgatttgtagctgatccaactgccacgagttttgggcgtcgaaattcctagacttcttgacaccgatggatggaaattatgccgacctggcgacatgatccttaagtggtgtttgaatctcgattaagataaagattaagtgtttcacgcaaaacgacaaaacgaggtggtaataacatgtgattatttgagttttaattattacaaacttgaaaaatgaattaatctgatattttagagcaattttcatatagaaaatttttgcacgaaacacatcgtttagcaatttgaaaagcgtgccacgagtatccaaaatttcattcaactcttgtcagagaaacgaacccaacctaatttcggccatcgagatttgaatattcgataagg

SEQ ID NO: 63 - DNA, 8993 bp, Oryza sativa
  misc_feature (1)..(8993): AF141965 5'-regulatory sequence engineered
tgtttctcgattaggctacaagttaacatcagatttatgggttcaaatatagtactagtttacatcgcatttaacagtagaattatttctcaaaacaaaattgtagtatctgatttttggtaatgagtttgtagcatggaatgatgctgtgttctgatttgcacaagaatggcatgcgtactatgcatgtcaagggctcaattgtgatgatttgtaccccttttttttgtgaaattcagatagattgctacatgctttcctcttttggtttctgcatataatcctggtttcttctagaggagttctaatttggttgtcccatgttgtaaataaaattatgattgtaagtacaaatggctataaaattgatacggcattcacaatattatattgagatatttctttttatataagattagcacacaacttttcattcgagtactgctctcattgagatggccagatactattttctgattgaaaagtccacgcccatgcatatggttttaattaaaaggcacatgtgttttcgtgagaatgtgaaatcaaagcatgtcgctattgccatgattatcctaagatttcacgctcttgcccgcaaaaactttaacgggctactcacagggaaaatagttggcagatagccacgctttaacgtacgattgccatatatatgaaaaacaaaacaagccatacgcctagccacttgcttttgacatatcccactctggtgtctggacaaggatagaaacaaaccccaccaccattcatgggccgtttgatttatttatttctagcaatggtagattcttttattgggtcggaaaacggatgtgagccactcttgtggtacatgttaacacaactttaactagttcattttagtgatgagattagggatttttcgctggtctccgtctcttcgagtatgtgttaggggcacatccacggttaaatcgagaggttcactccatagaatcaataatatgtacattaggacatactccctccgtcctgcaataaatgaatctagctaggactgaatgtggatgtgacacgttctacatccaagactagctggattggtttttaatgggcgaaggaagtaataagaaccaaaatggttaaagcttgaccatcaatctaagcataagagcaagtataatagtaggctataagccggctaaatgctgaggtggatgagagaagcgggctgtagacttacagccggcttgagcataagaaccaagaaactctgtgagagagacaaatgggtcctatattaattgtaaagagctaactattatataggtaggctgagagaaagctacaaagaaccttatagccaataggtcggctgtattattagccttgctctaatgcagttgccagaaatgtcctaggcgggaatacctggggtgcaaatgggtgaattctttcccaccaattggcgcggtccctctgatctctctttccccataggcggaggccagctaagcggaaaggggccacctggtggtagtgttggggcggggcctcgcccacttgttcctacgcccctttccgcgcgaggaggtgggacgagagacgacggcgatccacggccaatggcgattgccggtctcggtcggtcgcactcgcgctcgcgcgcgggcgcctcgtgggtcgcgggtttcccaggacgggaagtcgctcgcgcggtcgccttctttatttggctacctcctcctcctctcccctccccacccatctcgccctcgtctcgtctcgtctctccactcccccacctcccatccgctactgctagtactactactacccggcctctcgccttctcgcgcgcccgcgatttccgttcgcaaatccgcacccacggcggcgcgaggtcgccgtcgtcgtcgagccatttcgggtgagagggggggtctccggtttttctcagatctgtccacttttgtccagttttgatctggtgatttaatatactatttttcacttctggtggtttgcggcgacgcgtgtgcaggggggtagtttataagggcttgcgcgaggagggggaggagtagcgggtagcggcggctcgagtcgagtcgtcgtcgtcgtcggcggcggcggtcgagagagatcgggatcgatcgtgcgggggaggacggagctgaagcggattgagaacccgacgagccggcaggtgaccttctccaagcgccggaaaggcctcctcaagaaggcgttcgagctctccgtcctctgcgacgccgaggtcgccctcatcgtcttctccccccgcggcggcctctacgagttcgccagcgcccccaggtataccttcttctcgttctcggcaagttctcgccggaaattattctctcgctcgtttcgccctcgtcgtgctgctgcatcaaatgcaaatgcgatttcattctctctctctctctctgtggtaatcgggtgatttttgtggtttggggggtttgaggattcggctgttgggattgcttgttcgtcagagtttgaattcctgcccttaattccgtcgaacaaaaatgggttctctgttcggatttggcacctgcggatttggccaccgctgctgcgacgacgaagacgacggcgacggcgaccgccggccacacacactactagtagcctactagttcgtcttgcttctcacttgctattattgttattattggaagctgtgaactcctgtagaagttgaccccttctctccccctaaatatctgtacggccctggagaccggatggatatgcccacacctcagcactctctcacagtcaccaccagttgcctgtagtatctcttcttcattcatcttcttcttcctctcacatgttaacaactgttccaaggagcatgtccacgagctctggattgattctctggcgcgtctctgtgcatcttccttccccattcgtcgattcttgttctcgatccgcgggaaaattgacgattaaaggaggctcctgacctctgaataaaatcaaggacaaaaacgtacaagaaggcagaggtaataaacccaagatagccaatatacaaagaaaaaccaaagtaaatggcagccaatgggaggaaggaggccggccggcgtgcgtggccagtaattgcggggtaggaagaaggctgcgagcctgcgagcgtgcgagactacaaatggagaaacaagctaatgtgacatccggtcagtgagatgagagatcattgggcgcctacctgcaccctctctctctctctctcgatccacaccactgcactgctcccctctcgatcgtacactggctgatgagctagccaagttgatttctctcgcaaaacgtaccacggattggtcgcatcagctccgttcgtcgagggtatggtgtgggggtatctttccatcatacacagtatgacgttggccacagtacatagcatgcgatatggctgtttctgaatattttttcagttttcagcaggtccgaatttgttaggtggaaccgtgatttatatatttctcccctcttccttgtggatatagtactcgtattgtgtatcttactcctagttctcttgcacccactccagctggagagtggagagagtggagagtacgtaccttatctggcgcacactgtactataatccttatattttggtgatcaggtgcaccgtttattatagattaatcatcatctcttagacatggcttgttgcaccttaatatccatctctttatcaggcttatatgtctacggcagtgaaaaagcgttgccagttaattcattgtcgtgcatgtagtttccaaaccatagtctagggaacactcaatgttgttccatgatattaagtgatgttaagtactccataacttaattagtactccatgccaatactcgacaacataatatttccatcacacttcatatatatgtatgctctccctctttctcaattaggaagatctatctagaaaattcttgagtttgcaagctatgatatgcaacgaactttcttctaatgtaagtgcaaaactatggattgtcattcattacttacgttacttcttaataaacattatcaagaagctagattgtagagcatgtaaagctgagtggaaaaggagttttggtaagcatgtgattgacatgtcttataggtcgtcgattgatctgcccaaacaacagtacaaatgaagttaattctactgtgaatagcatgtgataactcgcaatccgtagaatgctttggctttaaaacaataattttaagagtgtgagcaatgcttatgttacttcatcagattatcgtgtgccttaattcttatctgttgatcatatttagtactcctcctacccataaatatatgaacacttgaagcatttaaaatttatccacaaatatgatgattattcctagagtactactgatccctcttcccaaaataagtgaccaatttggatgtaaaatttgtttcaagataagtgatcacattacagtgctacttgtctattaatcacctcttgttcaaacttcttatcttacctcaactaccctcccacttctaaacatccctcatttaggtcatttgcctttcctcattatttggctcatatataagtgataaagtagcttattcatttattttagaacagatcgatggagtacttattacaacaatcacccgtcattcaaatttctttctaacttacactcaaccaccgtcccacctccatctctctatcttctcctccaactctctctcttttaatgaggggcaccaaaatattttcttctcaactttaatctctactaaacaatttggcatgtgtatatttgttaatggagggagtattttctaagttctaagtacttgatatatatcgtttaaccagaaatctatacctatgtgaaaaaaatacattgtccatagatcgatctttcatgagtatattactgaatcatgccaaatttggccaatgttacatattaattatgatcttaaagtttgttctgaaattactttgccttgaatcttccaagcaagtatatatatacgtgtaggcaccacacttctcatggtcaaatttagatatttatcaacctaattagtcagtccatatatagagagttaatgcaactagctagttgctttgtctaatgtgagatcttttgtacgtgaactgtaaacattatatatacaacctccatcctatattacttgtcgctttgagtttttatttgtaatgtttgatcattcgtcttattcaaaaattttttacaattgttatttattttatttgtgatttgctttattatcaaaagtattttaaatatgacttatcttttttatatttgcactaatttttcaaataaaacaaagggtcaaacgttgtaacgaaaaagtcaaagcgacatctattatgagacggaggtagtatgatcggtgtgctgtctttagtcctgtttaagatacttaatttctctgaaatacaattgctcataattacagtgttgttgtcagttttgtcttcttttccaaatactttatttgaaatatggataaatcaaacttaccttttaccctaataaactacactatacatactaatcttaataacatttatgcataacatttatggtttttgttcattcttttcaaatccgttccattctgggcagaatggggcaatgcaagtactgtcacaaagaacaaagaacagatggtgcagccggatatgcatatatatataccagctgaatttttggccgtttcaggaaaacttcaatttaaaatcaatgttggtactatcaaattaatagctgcaaagtctccactaggtctagcaagaaagtagcagctcaatggtagtaataacttcatatgtttatcgaacagatattagctttctttaaaagtccattaccaaacaaggcttatctaggggcatagtacccccatagacccatatgtaggagtaacaaagagaaaatgattaattacaaatattttaatgggcttgtttggcagggctccaactctaagtactagctaaattctgttctacctctctagttcattttataaaagcactctagcattctcctctctctttgtaggtggagctgaaaccgtttggttgggctctagctcaaggagaggtggagttggagctttgccgtatgggcccaatgtatataaaaaatatctataatttggttatagagtatttgtatttcaatgggaaaaaggtatatgtgttaatagtattatactcttctcataaaaatgagtgtgaaactaacttttgtaataatccttactattagttagctgagctcgaactattctttagtgtacaggcaacacgccccaattctacaagtgctgcaaccaaagctttcaatactggttttgccggaaatacccgtaccgcttgctggttgttacttcttccgtttcataatgtaagtcattctaacattgcccacattcatacaaatgttaatgaatctagacataaacatatgactagattcattaacatctatatgaatgtgggcaatgctagaatgacttacgttatgaaatggagggagtattagacaaatgttcaaatctaaaattttgaactcactgtggttcagtaacctgcaggcagagaaaaacagcatgattgaaagcacagttttgcataaacaatacatcgcaagtagatgaaaactattaaaacataatcatcaataatgatctgaccagtctaaaaaaatcaataatgatacgcatcaatagatataagtccatcatgaacaatcataatgcaataatccatcacaaaacccctacatagggcataccacaatattattccttctcaaattgtaattcaaggtataacacaatttcacagcacacataaatatcttattgatcttttctctctttccattagagatgtacctacagataacccttcaaagtgaagataaattcatatataaattttcaaatatgtttttctagattttcaaattataaaataaactgtcccaggcagttactagacgttgagatttctaacatggttgtgccatcaatggctgtttaatttctgtacatattacataacatatagtagggttgtcaatgagctgaacttgagcacatggcacatcaatttcgttttcaagttgaatgaatgatctaaattgaccttgagtgaacctgagttggtgccaacaaccgatgttgaaggtatgctcttgctaaaatttaattgaaaacttgagctttagcccgataaggtcacacgaactctatttatgcatgtctgaatgtgtttcatgcaaaaaagaaaaggcatggccaataatttcgaatccataaggcttgttagcttacatgtgttatccttcaatgaaaattatattctatattggacaaggtttcgattcttgttggtttatatggttgaaacttttatgcttggaacaattcctacctgatgaatcttgttattattcccaaagaatagccaaatacaatatatttgtttctactatataacaactacattttggcaagtcaataatttttttttgcgaggaggctagtcaataattaagtaggcacactcctatgcacgccaatcagattatgttgattcagaaacatgcatgcgcactgcacataagattgctcattgaggtagttgcattatttatttagctaagatattgccagcatggcaatgaagcagatatgatgaaaatggaggatgcagaatatatatcctcagcttttttttccaattatcaaaaagtttaaaccatcactaggaagagtgaagctcttgcattgttcatttaattaggtggacaacagaaggaacagttcagtttcataatatatagcggtcaagaaaaagtttcatattatatataatacatgtgattttgcgacttgatacatttatcgtagtatccattattcttgttaaactgagcctgccctgcctatggaatgattacctgaaatattattttagtggaactcagttatgccttttatattttattaaaaagatagaatttgagtttgtgtcccaattttttgttaccaggaaagattctaaaaaaactcaaaagatgttgactatctaatctttttgaacaagatagatacttagaaccaaatttacacaaagaataaagcattttaaaatgtaatacaagtagatgtatttcctagtctggtttgaactgcatacaaaaacaaaattgctccaaaggatgtctgtcatactggcaaatgtagacatgcttcttgaaaaagttggctcaaagatggtcaattatgcaatgtttttttttcaaataaatatatattttttaacatatgtactgaaattgaacgttttgtgatatacacagaacatgcaccagtttaacttgcagtcctgaattttattgatgtttaagtgcttgcgttcacttattggtaactatagaacgtccatgcatgtgctatcgtgtgtacagcttgggatgtaacatctgaattatgatataataaatatctaggaaggtaacaaaatgttcctcgctagtgctggtgttgatatattttcagagaaagctggaagcgcaactgtcaaatcaacagccgcctattggcattgaaacatacatatctacctctcgttgtttctacttttttttggcaagaatttggttggatatagttggccataggcctgtagccaccactgtttgtagcatcgcaatatgcacagacaaacatttgagctgctgagctagcagagctagctagtttattgtagcaggttggaacaagcacagctagctcaagtcatgcatgcactaataaattagagtatgtatgttttttgccccagaacgattatatcatcgatcttctgatttttagtttgctccttgtgtctgttctgcagcctacagaccaccatgg

SEQ ID NO: 64 - DNA, 819 bp, Oryza sativa
  misc_feature (1)..(819): AF141965 3'-regulatory sequence engineered
  misc_feature (1)..(308): 3'-untranslated sequence
  misc_feature (309)..(819): 3'-nontranslated sequence
agaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgcttccagctgcctctaccctcatatctcacctgcctgtgtgtttgtgtaaattgagcttgcgaaagaggaaggtagatgctgttaatttatgggagtggaagctaaatgttgtactactggagtactgatttgtagctgatccaactgccacgagttttgggcgtcgaaattcctagacttcttgacaccgatggatggaaattatgccgacctggcgacatgatccttaagtggtgtttgaatctcgattaagataaagattaagtgtttcacgcaaaacgacaaaacgaggtggtaataacatgtgattatttgagttttaattattacaaacttgaaaaatgaattaatctgatattttagagcaattttcatatagaaaatttttgcacgaaacacatcgtttagcaatttgaaaagcgtgccacgagtatccaaaatttcattcaactcttgtcagagaaacgaacccaacctaatttcggccatcgagatttgaatattcgataagg

SEQ ID NO: 65 - DNA, 3267 bp, Oryza sativa
  misc_feature (1)..(3267): AF174093 5'-regulatory sequence
  misc_feature (1)..(2408): 5'-nontranscribed sequence
  misc_feature (2409)..(2596): Exon
  misc_feature (2597)..(3254): Intron
  misc_feature (3255)..(3267): Exon
aaaattcacaagtataattcgtcacgcactgcatgcaaatatgcagtgatgcacacacagctaacggtcccgggttctcccaccgcccatcgcctagagacaagttcaagcgcagtaccgcctacactcccatgtgctagctgcttccatgcttgcctactctctgtttacgagtagtgagaagcagagagtgagagagacgaacttgatggtgatgcaccctaacgctgcgctcccagtcaaagtcaaacgcagtagcacctagtacgctcctactccctccggaggtatcattttaattaatattttagacaatgacacggtctacaaaatatatctttaaccttatttttctattataatataaataataaataaatacatgtttacttttattatagtgctttgaaagacaaatctatacatgttgttctagttcctttaaactaaatatttttaaagttatcgatgatcaaagttataaaagtttgacctcaaccgtgtctaaaacgtcaattaatatagaatcggagggagtatactcgtagtcgtatttgatcatccataaacgcgtccaatatctttgggtaatggattttgcgacataacaaaaagtttagaccagtttttttactagagacgataacaacgtgccgagcaattttggctctcaaataatgatgttgttttttatgggaaaacggtttattttcctttgcaggttgttttcttgattatttctccagaagctcggtttatatggtattatcacttcagcttatttatatttggagcaagtggttaaggagttttatacctggcatttgggtgatgacctagttttcgagttgtaagaccttgatctcgagagtttttatgattttctctcttcttttaaggcctcgtttgatctatccttttggagataaatttttagtgcacgtaaaacgagaaacctcattaccatatgattaattaaatattaataattataaacttaaaaatagattttatctgaattttttaaacaacttctatatagaaaattttgcaaaaaaaaacacatcattgactgtttgaaaaacatgctaacggaaaaaagttgaagtttggagttgaggcaaagaacttagcctaagtgtgcagtgtcttgttcacttggttgtgtgcactatcatgatacagagggcctgtttagatcccctggtaaaattttataccatgtcacatcgaatgtttggacacatgaagtattaaatataaacgaaaaaataactaattacacaaattgcgtgaaaattgcgagacgaatcttttaagcctaattgcgccatgatttgacaatgtggtgctgcagtaaacatttgctaatgacggattaattaggcttaataaattcgtctcgcggtttacaggcggattctgtaatttgttttgttattagactacgtttaatacttcaaatgtgtgtacgtatattcgatgtgatacgcaaaactttacacccctgaatctaagggtgtgtttacaagcgaaattagtaatttgttttgttattaatctatgtttaaatgtgtgtccgtatactttaaaatttttttggccaaataactaaacacgaccatagtcccatatgctgcttttgggttagagaccagcccgatggtgacaaactgatccaactccaaccaacgtttgcgttgaggtgctctctctgaatttttcttgtgccccatgacgttgctagctgcttttgccgattagcctcgtttcgttgcttttgctctcctgctgcaatgctgcctgcggctgccacgaacttctatccgcggagagcgacgttcgttcccgatcgaacctgaaacttcctggcattttcacgcgcgcgaacgaacgaacgaacggacgaactgtactgtaaatactcaggcgcccgaacgaaagttaacgaacgaacgaaagctgaagtgctgaacgaacggtagactgtaaaactcaggcgctccgaacgagaagttcagtgaacgaaagttacagccatcggtgaattcacagtgctagtgccgtggagatcgcggcctataaatacgcttcgttgctttgctcctctccttcagctcgaaggaagccgttccagtgtctcacaagccaaggtaaagaaaaaaaagagagagaaaaaaacagagaaggaaatcaagagaagaacaccatttgattctcctctctgctcactccttctccttcttctgtttgtccgtcttggattggagctagcacttctttgactgcccttgttcatcgaggcaagtgcagaaatcttttcagtgtggctggatcccgtttaattcaagcgatttgattggggttttttggttttttcgatggacaggcggcgaggcgaggtcgcgatggggcaagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatgtgcgccgccgccgcccggccctagcttctatctctgtttcttgttaatttgtttatgacgaaatgccaatgaaaaatctgctttaaaagaaacaagaaagagagagagagtgtgtgtgtgtgtgctgatctctaatcttgatttctatatatctgcatgccttagctgagttttcagttctttgtggtgattggtggtgtgtgcgatgattcagaaatttagcattgcatttatttgttgcagttgatatttcactcagcattccagataaatgtttgggggtactgttcgattaacatcccgatcaaatgggtagtgttcttcatgattggtagtggatttgggaaattgggatcgctttccttgcattcaacattatcactagaaatctttcgatggttcatgttctagagcttgcttttctttctgatttaatcttttctggcatcctgaaattttgatttcaggatctattcctataggacttgtgcttgctgcatagtgcattcttcaattaagcagtgcccatgaccacatcgattagtactactagaagctaatactccttttacatgtataagttcacttcattggtccaatgtactagtaataccatattgtttctggatgtaacatatttgattatgctttgttaagcttgatggagctg

SEQ ID NO: 66 - DNA, 1068 bp, Oryza sativa
  misc_feature (1)..(1068): AF174093 3'-regulatory sequence
  misc_feature (1)..(66): 3'-untranslated sequence
  misc_feature (67)..(1068): 3'-nontranscribed sequence
tgacttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcgactgaatgggtcgaccttatggcttgttttgcaaattttgaaccttgtcctggatgtagtttatttggcttgtttatccctttcgagtatataataactgaggaacttctaataagcttcttaactaaactcgctcatatgtaagtcttaattaatgtcttgaatctatacttgatagcccaaacaatatattgtatatctttttgttgtttcgccgtagcgttagcacgggcatgtaactagtataaaatagttatcaaatttttttaaaagaactgataagatagatcaatatgaaaatatttcactccataaacatacaagtttaaattcaacttttataaattacaacaaaaatgacaaatataaccgtgaatgcgggttaactatttccaatttaatttattctttttttaacatgtggacgttgaatttaggagtattataatactcaatttgttcggctttagatgagtgagaactggcacagcgagaactggcagagccctggttccggggaggcgtcggcaatggaggcgctgacgatgctgccgccggcggcggcggcgacgacggcggcggaggcgttcaattgcttcttcccggaggaggagaagggg

SEQ ID NO: 67 - DNA, 3268 bp, Oryza sativa
  misc_feature (1)..(3268): AF174093 5'-regulatory sequence engineered
aaaattcacaagtataattcgtcacgcactgcatgcaaatatgcagtgatgcacacacagctaacggtcccgggttctcccaccgcccatcgcctagagacaagttcaagcgcagtaccgcctacactcccatgtgctagctgcttccatgcttgcctactctctgtttacgagtagtgagaagcagagagtgagagagacgaacttgatggtgatgcaccctaacgctgcgctcccagtcaaagtcaaacgcagtagcacctagtacgctcctactccctccggaggtatcattttaattaatattttagacaatgacacggtctacaaaatatatctttaaccttatttttctattataatataaataataaataaatacatgtttacttttattatagtgctttgaaagacaaatctatacatgttgttctagttcctttaaactaaatatttttaaagttatcgatgatcaaagttataaaagtttgacctcaaccgtgtctaaaacgtcaattaatatagaatcggagggagtatactcgtagtcgtatttgatcatccataaacgcgtccaatatctttgggtaatggattttgcgacataacaaaaagtttagaccagtttttttactagagacgataacaacgtgccgagcaattttggctctcaaataatgatgttgttttttatgggaaaacggtttattttcctttgcaggttgttttcttgattatttctccagaagctcggtttatatggtattatcacttcagcttatttatatttggagcaagtggttaaggagttttatacctggcatttgggtgatgacctagttttcgagttgtaagaccttgatctcgagagtttttatgattttctctcttcttttaaggcctcgtttgatctatccttttggagataaatttttagtgcacgtaaaacgagaaacctcattaccatatgattaattaaatattaataattataaacttaaaaatagattttatctgaattttttaaacaacttctatatagaaaattttgcaaaaaaaaacacatcattgactgtttgaaaaacatgctaacggaaaaaagttgaagtttggagttgaggcaaagaacttagcctaagtgtgcagtgtcttgttcacttggttgtgtgcactatcatgatacagagggcctgtttagatcccctggtaaaattttataccatgtcacatcgaatgtttggacacatgaagtattaaatataaacgaaaaaataactaattacacaaattgcgtgaaaattgcgagacgaatcttttaagcctaattgcgccatgatttgacaatgtggtgctgcagtaaacatttgctaatgacggattaattaggcttaataaattcgtctcgcggtttacaggcggattctgtaatttgttttgttattagactacgtttaatacttcaaatgtgtgtacgtatattcgatgtgatacgcaaaactttacacccctgaatctaagggtgtgtttacaagcgaaattagtaatttgttttgttattaatctatgtttaaatgtgtgtccgtatactttaaaatttttttggccaaataactaaacacgaccatagtcccatatgctgcttttgggttagagaccagcccgatggtgacaaactgatccaactccaaccaacgtttgcgttgaggtgctctctctgaatttttcttgtgccccatgacgttgctagctgcttttgccgattagcctcgtttcgttgcttttgctctcctgctgcaatgctgcctgcggctgccacgaacttctatccgcggagagcgacgttcgttcccgatcgaacctgaaacttcctggcattttcacgcgcgcgaacgaacgaacgaacggacgaactgtactgtaaatactcaggcgcccgaacgaaagttaacgaacgaacgaaagctgaagtgctgaacgaacggtagactgtaaaactcaggcgctccgaacgagaagttcagtgaacgaaagttacagccatcggtgaattcacagtgctagtgccgtggagatcgcggcctataaatacgcttcgttgctttgctcctctccttcagctcgaaggaagccgttccagtgtctcacaagccaaggtaaagaaaaaaaagagagagaaaaaaacagagaaggaaatcaagagaagaacaccatttgattctcctctctgctcactccttctccttcttctgtttgtccgtcttggattggagctagcacttctttgactgcccttgttcatcgaggcaagtgcagaaatcttttcagtgtggctggatcccgtttaattcaagcgatttgattggggttttttggttttttcgatggacaggcggcgaggcgaggtcgcgttggggcaagggaagatcgagatcaagaggatcgaggacgcgacgaggcggcaggtgacgttcagcaagcgcagggctgggtttctcaagaaggcgaaccagctcgccgtgctgtgcgaagcgcaggtcggcgtcgtcgtcttctccgacaagggcaagctcttcgacttctgcagcccgccggtcatgtgcgccgccgccgcccggccctagcttctatctctgtttcttgttaatttgtttatgacgaaatgccaatgaaaaatctgctttaaaagaaacaagaaagagagagagagtgtgtgtgtgtgtgctgatctctaatcttgatttctatatatctgcatgccttagctgagttttcagttctttgtggtgattggtggtgtgtgcgatgattcagaaatttagcattgcatttatttgttgcagttgatatttcactcagcattccagataaatgtttgggggtactgttcgattaacatcccgatcaaatgggtagtgttcttcatgattggtagtggatttgggaaattgggatcgctttccttgcattcaacattatcactagaaatctttcgatggttcatgttctagagcttgcttttctttctgatttaatcttttctggcatcctgaaattttgatttcaggatctattcctataggacttgtgcttgctgcatagtgcattcttcaattaagcagtgcccatgaccacatcgattagtactactagaagctaatactccttttacatgtataagttcacttcattggtccaatgtactagtaataccatattgtttctggatgtaacatatttgattatgctttgttaagcttgaccaccatgg

SEQ ID NO: 68 - DNA, 1065 bp, Oryza sativa
  misc_feature (1)..(1065): AF174093 3'-regulatory sequence engineered
  misc_feature (1)..(63): 3'-untranslated sequence
  misc_feature (64)..(1065): 3'-nontranscribed sequence
cttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcgactgaatgggtcgaccttatggcttgttttgcaaattttgaaccttgtcctggatgtagtttatttggcttgtttatccctttcgagtatataataactgaggaacttctaataagcttcttaactaaactcgctcatatgtaagtcttaattaatgtcttgaatctatacttgatagcccaaacaatatattgtatatctttttgttgtttcgccgtagcgttagcacgggcatgtaactagtataaaatagttatcaaatttttttaaaagaactgataagatagatcaatatgaaaatatttcactccataaacatacaagtttaaattcaacttttataaattacaacaaaaatgacaaatataaccgtgaatgcgggttaactatttccaatttaatttattctttttttaacatgtggacgttgaatttaggagtattataatactcaatttgttcggctttagatgagtgagaactggcacagcgagaactggcagagccctggttccggggaggcgtcggcaatggaggcgctgacgatgctgccgccggcggcggcggcgacgacggcggcggaggcgttcaattgcttcttcccggaggaggagaagggg

SEQ ID NO: 69 - DNA, 7967 bp, Oryza sativa
  misc_feature (1)..(7967): AF204063 5'-regulatory sequence
  misc_feature (1)..(2163): 5'-nontranscribed sequence
  misc_feature (302)..(302): r is a or g
  misc_feature (1620)..(1620): s is c or g
  misc_feature (2164)..(2421): Exon
  misc_feature (2422)..(7951): Intron
  misc_feature (7952)..(7967): Exon
acaaatttgttgtaccacctacctaggggtgacaacactgcacatttggctatttagggccacgcatatatgcatgaaaaattgacacacgacgttacttgagaacctattcatgcaggtctatgagaaaaccccaccaaaaaaaacagatgtgcaaaataatgctggattttcatatgctataaattaagtactactttaatcaaacaccacattgacacacaatgacacaaattaaatactcttacgaattcaagtcatatatactctaatacgcacgtgcagcttgttactcaaataargaaacagggcaatacggatcagtatatccaaccaggctgcatgtaggccaagaacctgacaattcgttttccttggagaaagcaaagaacgtttggaacgtgtgatgtacatgcagatcgaggaaaatagctaatcctgctctttccctttccagcacaaaaaaagattccttcgtagttcgcactgcatttatactcaaacctgcaaggctcccaaacagtttgaaccaaggcgagggaaaaaaaaaacatctccatagccaagagaaaacatactgtacatgtcaagagattccctcttcatattcttacaatcctatttactcaaattaaatcttcatatttcacttcgtaaattccaacggctaatttggtcagcacaaattcagcatctcaatcaacacaatttcaatgcatgaaggcgatcaagctcaccactctcctgccatacaagatggaccgccaccgcttggaatttccgcagtgacggcaacacgaggaagaggcaacactagcggatgtatgaaggagtctgccaagctcggctatttccggcgagcttgagagtataatcgagatagaggccggtggaaagacgaaaggcggcgtactcttgggcttagtgtggaggcaacggtggcggcctcgcggagaggtgacgacaccttggcttggcatggcagagttccacttctcaacagggatgcatgacactcctaggtaagaaggcggcggtgctggtgggtgtgggtggaggcacatggacttctctcaacaataaagttgctctcgctgtcaaactattccctctgccaagtttgatcactcaatttcttgatttggctagtcggataagatagtcaccgacatagccaaccagatgggataacccctttttttttagcatggagagtgggaccaaatgtccaagctatctcccatactccctatgtccaaaaaaaaataatattttttaaattcatatctaacatacgaagataatactcttcgttgaaaaaaaaacaacttcagaatctagacacaactttattttttataagacggaaagactgtactcctatactcctacatttcaccatttttttccccgcgtaaaaacaaacccccgaattgaccgtccactgtagcatcactccatcagacttgaagcgagtgagagacagagcgctgcgttaaaaagaaaagaggaaagaaccggacgcagagccctactgtcaaactgacaaggcaggaaggaagaaaagggaagccccccctaccaagccctagcctccttgtccgtttgctcccccccagsgccaccccccgtcgacacgcgtcgcccaccctctgccattccctcttccgccctcccagccactactacgcttttactccctgccgcgcgcgcgagatcttcaccttcaccgtatccgctcgcgttttgcacgcagttgatttgcgctttgtttttgcatcctacgaaactaaccgcacaccaatcacctcctccaccaccgcacagagctatagctagcgaggagcgtgctacagtgcgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatggtacgtatagcaccaaaccaacgccgccgccgccgccggcgtgcttgttccggcgcagcagcgcatcatcatcgatcgatctaagtctaataagataatcaattaaccctaactaaataaaatgataagaacagtatatatggttatgatcagtgaaacactcgtcgatctgagggaaaatccggtcgagatcgagggagtggggagacaaattgaactgcaggctagctaatttaatcgtgtcgatcgatttctagcttttgttgatctttatatatacgaacgcatgcactttcccctttgtttttttttcccttcgatctgcttggagctcatatgctatagatcttggggcatatgtatctgtcagctttcgagagcggctatgtccatcgatccctcttttttttctctttctttttgtagtatcagctgccatgcatatatcagatttcgttttcgcgtgcttttagtgcttcacttatctgttcgccatatctgatttcttctcatcctttgccgacgtcgtctgagcagtctgacctccaagatctggcgaaataaacctcaatcgttgctatttcttgccttgaatctgcataaacatgacaatagatccttctattttttttcttcaagacaagatcttgctgtttcttcccttgctatttttcattcaaagattcttcttttttttctaaaagaactatatatatatgaatcgagtttcatcttcatcgatctgtctctctccttttgttttctgtaaacacacacacgagcgtacgtatatatactctcatctctacttttatcaaaaagaaacacacatgttctagcttcagatcccaaaataatcaaacaggaaaatatatataatatgcaattagttcagatcccgaggtagatttcttgattatttccattttccaaagtgaggcgcgcgacaactcgacgcggttcctctttgcacacacacacagtataactgtacgcaaggggtaagaacaaaggagcaatcccttctgggttgctgcttgcttctcccatttttagctatttcagaatttcactttctgagactcatctctctctctctaccagctgcattatttcacttcccttttttcccatttctgcctattacacggatggcctctttgtggactcgtccaaattgaggcacggtagctggtgtcaaaatgaacctgcaggcccagcccggttatgtatatgtatagctatatagcttttcttgcaagaggtatatacactttgtagttttagccagtggtccagctagccatggatggatatattatacacacgtatatatagtacatgtatgtacgagtgttaattaaactcgtttagttaatttccaaagtccttttttattactacagctagcctgatctgtgttttagtgtgttactgttccattagttactgttctattgaagagagcgcgtacacgttgttgttttatttctctttttccgatccggtgttccttttttttttcttttggtcatcttcctcgagtcccgagcagtagaaatactactactgccctgcaaagcacacacatcaagtgatgtgtttttcttcagagcttcagacgtgtcatatcaagcaggtcagcacgcattacatgcaatataatactcctatatggacacgcagaactcactttgatcatgtgtgaccaagctggatgagccgttaatttgttgttgggacagggtattgaatcattaattgcggtttttcctctttttcctgtcttgttctactcagagaattgaacggtgaactgtataggcagagctagtcctgcatgcatcggttttctgaaattattaactatacacacacatgcacaattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgggaaatgctattggaactactagttttcgggacattataagaaaatgtatgcatatatatatatatatatggacttatgatatgggccagatacctatatatatagaagatatatgtgtgctactacctccattcaacaatacaagcatttgagccagttctggtcaaggatataaacatcctgcactattagcttgtacttgtcaaattaatgatctctaattcaaactttcttgctactttacccccaatcacccttcccaaccatcttaatctttgctaaacattctagaaatgcttattgttggatggaggaagtagctattaactactcctatagtttttttaactacctcatattaattttgtaatcctaataaatgcactatatatgcccacttttaccgtgtttccaaactggcatcaagctaaaatgaatgttaatttagtttccccataattttatgagaatcgcaaaattgtacctattttaaacaaatcaaagtcactgaacaaatgaacggaggttaattattatattcacctgatataggcagactaggttgggctaagagggacattaatttgggcatctaggttttgaaatgggagatatggagagtgaaccaaaaaaaaactgttagtgaattagtacatgatatatactagtattattagtgggaacctagagaaatgcaaagaatgttgcgcaaatcatcattttgtgtaaattaaaatgggatatacactatggggaactatagctgagtgtcaatccccaccttttgtttgtaattaaacatgtgtttatgctacaaattactccctccgtactcataaaggaagtcgtttaggacaatgtttaagtcaaaccttgggaatataaattatgaataactctcaagttgttgagtttgaaaatgtaaaaaatatatgaatagatttgtcttgaaaaatactttcataaaagtatacatatatcacttttcaataaatattttatagaaacaagaagtcaaaattgtgttttggagaccgtgtcactgtccaaaacgacttctttacgagtacggagggagtatgttctacatattggctaatattgttgaacccttcggatcaatcttagacacagtagccattttacccactgatgcagcaacccaattaggtatctactaattagcatcatagtgcaaatttgtacttttcaagtggaaaatagaaattatttgtcctcctttactttaatttcttgataatatgatatatgtaacataatttctctttgctcccaagcatataaaaaacttcaatttgatatgtccaaaaaatgtcatatatatagcatgtaatcctctgtggcaaacacgtttttttggctcaaattaagaagaggaaaaaatggtatatatgtataaacctaacaaaaatgccccaacaagaatagctttattttgtgaacaaggtcatatagaccagggaacaaaaaccctgtactgtgcttctattttgctatgcattttggataagtgattctacagaaatatgactatataggagatattctcaaatctgatcttttctattaattagcccatacgatatgaagacatatcttcctctgttctgattctatttgttgtgctaagatagtctacaggatttgctaggttgccacctgccgtcaacaaaattcagctcatcagattttgttatagttgctagcacagttatattatacgtatatctcttttgagaatatattattacagtccattgatttttcttgtagagtggaaaatattattgtgttttctaaccgtaggagttcatgtggtgttatttattttggataatgtggtgtatttttatgagaaatcaggatcgcgtcaacatgaaagtttcatctaatacattattaagtgcatcgtagcaacaattcatatattaactcaaaggtagctttgaaattaagatgcatgtcattaatgcataatagagaaatcaggttaccaaattatattaagcccatatattaactcaaaggtcatagctttgacaaatgctccttacagatttctccttgaaccaatttgtaaaatatcctctcctttttttttgcgcgaacgctaaatatcctttgtttaacaacctcgtcaatttgtccatttcatatgtgtgaacatccttgtacattcttttttgtgccgtttgaaataaaactttgaataaatatgcacaacttaaatgcttaaatgtcaattggatttggatgaaacaaaaccaaagttttagaatttacgatctatcattatgaatttatgtatgatatatcacactctttctgaataaacttcagaataatataaattgcttaattatggtatacatgagcatatatagcttgcgcaaatcaaaactgtacagtaggtgtgtgttcaattcagaatagtattctatttcgaatttaaattaataataccttctgtagtaatttctatattagaaaatttatacatacaaggagcactgttaattagctagctagctttatgggttccactaatcaatttatatataataatgtgctaaactatacagcgtccatgcatttttattcttcatgcctaattaatttgattcaccattaattaattctacgtacaatgttcgaatgtgtgactatatatgctgcatctgcagttctgcacctcattcagtactaaattcaagttcaggttcattaattaattcacttattccttcatttttcacttccagcatgtacaaaaccttg

SEQ ID NO: 70 - DNA, 1181 bp, Oryza sativa
  misc_feature (1)..(1181): AF204063 3'-regulatory sequence
  misc_feature (1)..(329): 3'-untranslated sequence
  misc_feature (330)..(1181): 3'-nontranscribed sequence
tgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccaaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctcaaaaacttgtggagattatgttagggagtagtgcaagaaatgttttaagacggcagctgttatctcatgagatattgataatgatgttgtctctgctgctgtcgcgatcgccaaattatgctgtttttttagattataccgaaatatgctgatggatacgtggttttgatctgtggccgttgcgaagtaagcgcgatttatttctgcaggcgttcgaatcacgttttactgttggcggtagttactgcacggtgactgttcgacgaaatgccaaaacaacccgcaggctgcagccagtcgacatgtgcggcggccgtcgcccgatcgcgcggctagctagtagctgtcggcaccgccggttggttacccgcaccaccgggccctcgccgtcgccgtcggccgtccttgcgctgcacggacgcgtcacgcgcactgccgcctgcctgcctttgcgctgtcgggcgggcgcgcgggcagaaagcgaccgcgcgcgcggaggggggcgccctcttccacacgcagcgatgcggaggcggcactggcacggaactcccaccgagccgacgggcccgcccgcccggcggccggccgcgccgcgccagcagctggacgaacatgcgtgcacagcgcgcgcgcaggcgaggcgcggcgcgacgtggtgcttcggctcgcgtcctcgcgtacgtacgccgccacggccaccaccgccatcagtgtcgcgttatgcacttactcatactgaacactggacagagcacgatatgcagcggtgtttgtaccgcccggcccaagggacggcagactcgccggcagaaaatcaaattaaaattgcaatgttgcaagtatatgcag

SEQ ID NO: 71 - DNA, 7968 bp, Oryza sativa
  misc_feature (1)..(7968): AF204063 5'-regulatory sequence engineered
  misc_feature (302)..(302): r is a or g
  misc_feature (1620)..(1620): s is c or g
acaaatttgttgtaccacctacctaggggtgacaacactgcacatttggctatttagggccacgcatatatgcatgaaaaattgacacacgacgttacttgagaacctattcatgcaggtctatgagaaaaccccaccaaaaaaaacagatgtgcaaaataatgctggattttcatatgctataaattaagtactactttaatcaaacaccacattgacacacaatgacacaaattaaatactcttacgaattcaagtcatatatactctaatacgcacgtgcagcttgttactcaaataargaaacagggcaatacggatcagtatatccaaccaggctgcatgtaggccaagaacctgacaattcgttttccttggagaaagcaaagaacgtttggaacgtgtgatgtacatgcagatcgaggaaaatagctaatcctgctctttccctttccagcacaaaaaaagattccttcgtagttcgcactgcatttatactcaaacctgcaaggctcccaaacagtttgaaccaaggcgagggaaaaaaaaaacatctccatagccaagagaaaacatactgtacatgtcaagagattccctcttcatattcttacaatcctatttactcaaattaaatcttcatatttcacttcgtaaattccaacggctaatttggtcagcacaaattcagcatctcaatcaacacaatttcaatgcatgaaggcgatcaagctcaccactctcctgccatacaagatggaccgccaccgcttggaatttccgcagtgacggcaacacgaggaagaggcaacactagcggatgtatgaaggagtctgccaagctcggctatttccggcgagcttgagagtataatcgagatagaggccggtggaaagacgaaaggcggcgtactcttgggcttagtgtggaggcaacggtggcggcctcgcggagaggtgacgacaccttggcttggcatggcagagttccacttctcaacagggatgcatgacactcctaggtaagaaggcggcggtgctggtgggtgtgggtggaggcacatggacttctctcaacaataaagttgctctcgctgtcaaactattccctctgccaagtttgatcactcaatttcttgatttggctagtcggataagatagtcaccgacatagccaaccagatgggataacccctttttttttagcatggagagtgggaccaaatgtccaagctatctcccatactccctatgtccaaaaaaaaataatattttttaaattcatatctaacatacgaagataatactcttcgttgaaaaaaaaacaacttcagaatctagacacaactttattttttataagacggaaagactgtactcctatactcctacatttcaccatttttttccccgcgtaaaaacaaacccccgaattgaccgtccactgtagcatcactccatcagacttgaagcgagtgagagacagagcgctgcgttaaaaagaaaagaggaaagaaccggacgcagagccctactgtcaaactgacaaggcaggaaggaagaaaagggaagccccccctaccaagccctagcctccttgtccgtttgctcccccccagsgccaccccccgtcgacacgcgtcgcccaccctctgccattccctcttccgccctcccagccactactacgcttttactccctgccgcgcgcgcgagatcttcaccttcaccgtatccgctcgcgttttgcacgcagttgatttgcgctttgtttttgcatcctacgaaactaaccgcacaccaatcacctcctccaccaccgcacagagctatagctagcgaggagcgtgctacagtgcgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaagatcgggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgccgccgcctcttcgagttctccagctcatcttggtacgtatagcaccaaaccaacgccgccgccgccgccggcgtgcttgttccggcgcagcagcgcatcatcatcgatcgatctaagtctaataagataatcaattaaccctaactaaataaaatgataagaacagtatatatggttatgatcagtgaaacactcgtcgatctgagggaaaatccggtcgagatcgagggagtggggagacaaattgaactgcaggctagctaatttaatcgtgtcgatcgatttctagcttttgttgatctttatatatacgaacgcatgcactttcccctttgtttttttttcccttcgatctgcttggagctcatatgctatagatcttggggcatatgtatctgtcagctttcgagagcggctatgtccatcgatccctcttttttttctctttctttttgtagtatcagctgccatgcatatatcagatttcgttttcgcgtgcttttagtgcttcacttatctgttcgccatatctgatttcttctcatcctttgccgacgtcgtctgagcagtctgacctccaagatctggcgaaataaacctcaatcgttgctatttcttgccttgaatctgcataaacatgacaatagatccttctattttttttcttcaagacaagatcttgctgtttcttcccttgctatttttcattcaaagattcttcttttttttctaaaagaactatatatatatgaatcgagtttcatcttcatcgatctgtctctctccttttgttttctgtaaacacacacacgagcgtacgtatatatactctcatctctacttttatcaaaaagaaacacacatgttctagcttcagatcccaaaataatcaaacaggaaaatatatataatatgcaattagttcagatcccgaggtagatttcttgattatttccattttccaaagtgaggcgcgcgacaactcgacgcggttcctctttgcacacacacacagtataactgtacgcaaggggtaagaacaaaggagcaatcccttctgggttgctgcttgcttctcccatttttagctatttcagaatttcactttctgagactcatctctctctctctaccagctgcattatttcacttcccttttttcccatttctgcctattacacggatggcctctttgtggactcgtccaaattgaggcacggtagctggtgtcaaaatgaacctgcaggcccagcccggttatgtatatgtatagctatatagcttttcttgcaagaggtatatacactttgtagttttagccagtggtccagctagccaaggatggatatattatacacacgtatatatagtacatgtatgtacgagtgttaattaaactcgtttagttaatttccaaagtccttttttattactacagctagcctgatctgtgttttagtgtgttactgttccattagttactgttctattgaagagagcgcgtacacgttgttgttttatttctctttttccgatccggtgttccttttttttttcttttggtcatcttcctcgagtcccgagcagtagaaatactactactgccctgcaaagcacacacatcaagtgatgtgtttttcttcagagcttcagacgtgtcatatcaagcaggtcagcacgcattacatgcaatataatactcctatatggacacgcagaactcactttgatcatgtgtgaccaagctggatgagccgttaatttgttgttgggacagggtattgaatcattaattgcggtttttcctctttttcctgtcttgttctactcagagaattgaacggtgaactgtataggcagagctagtcctgcatgcatcggttttctgaaattattaactatacacacacatgcacaattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgggaaatgctattggaactactagttttcgggacattataagaaaatgtatgcatatatatatatatatatggacttatgatatgggccagatacctatatatatagaagatatatgtgtgctactacctccattcaacaatacaagcatttgagccagttctggtcaaggatataaacatcctgcactattagcttgtacttgtcaaattaatgatctctaattcaaactttcttgctactttacccccaatcacccttcccaaccatcttaatctttgctaaacattctagaaatgcttattgttggatggaggaagtagctattaactactcctatagtttttttaactacctcatattaattttgtaatcctaataaatgcactatatatgcccacttttaccgtgtttccaaactggcatcaagctaaaatgaatgttaatttagtttccccataattttatgagaatcgcaaaattgtacctattttaaacaaatcaaagtcactgaacaaatgaacggaggttaattattatattcacctgatataggcagactaggttgggctaagagggacattaatttgggcatctaggttttgaaatgggagatatggagagtgaaccaaaaaaaaactgttagtgaattagtacatgatatatactagtattattagtgggaacctagagaaatgcaaagaatgttgcgcaaatcatcattttgtgtaaattaaaatgggatatacactatggggaactatagctgagtgtcaatccccaccttttgtttgtaattaaacatgtgtttatgctacaaattactccctccgtactcataaaggaagtcgtttaggacaatgtttaagtcaaaccttgggaatataaattatgaataactctcaagttgttgagtttgaaaatgtaaaaaatatatgaatagatttgtcttgaaaaatactttcataaaagtatacatatatcacttttcaataaatattttatagaaacaagaagtcaaaattgtgttttggagaccgtgtcactgtccaaaacgacttctttacgagtacggagggagtatgttctacatattggctaatattgttgaacccttcggatcaatcttagacacagtagccattttacccactgatgcagcaacccaattaggtatctactaattagcatcatagtgcaaatttgtacttttcaagtggaaaatagaaattatttgtcctcctttactttaatttcttgataatatgatatatgtaacataatttctctttgctcccaagcatataaaaaacttcaatttgatatgtccaaaaaatgtcatatatatagcatgtaatcctctgtggcaaacacgtttttttggctcaaattaagaagaggaaaaaatggtatatatgtataaacctaacaaaaatgccccaacaagaatagctttattttgtgaacaaggtcatatagaccagggaacaaaaaccctgtactgtgcttctattttgctatgcattttggataagtgattctacagaaatatgactatataggagatattctcaaatctgatcttttctattaattagcccatacgatatgaagacatatcttcctctgttctgattctatttgttgtgctaagatagtctacaggatttgctaggttgccacctgccgtcaacaaaattcagctcatcagattttgttatagttgctagcacagttatattatacgtatatctcttttgagaatatattattacagtccattgatttttcttgtagagtggaaaatattattgtgttttctaaccgtaggagttcatgtggtgttatttattttggataatgtggtgtatttttatgagaaatcaggatcgcgtcaacatgaaagtttcatctaatacattattaagtgcatcgtagcaacaattcatatattaactcaaaggtagctttgaaattaagatgcatgtcattaatgcataatagagaaatcaggttaccaaattatattaagcccatatattaactcaaaggtcatagctttgacaaatgctccttacagatttctccttgaaccaatttgtaaaatatcctctcctttttttttgcgcgaacgctaaatatcctttgtttaacaacctcgtcaatttgtccatttcatatgtgtgaacatccttgtacattcttttttgtgccgtttgaaataaaactttgaataaatatgcacaacttaaatgcttaaatgtcaattggatttggatgaaacaaaaccaaagttttagaatttacgatctatcattatgaatttatgtatgatatatcacactctttctgaataaacttcagaataatataaattgcttaattatggtatacatgagcatatatagcttgcgcaaatcaaaactgtacagtaggtgtgtgttcaattcagaatagtattctatttcgaatttaaattaataataccttctgtagtaatttctatattagaaaatttatacatacaaggagcactgttaattagctagctagctttatgggttccactaatcaatttatatataataatgtgctaaactatacagcgtccatgcatttttattcttcatgcctaattaatttgattcaccattaattaattctacgtacaatgttcgaatgtgtgactatatatgctgcatctgcagttctgcacctcattcagtactaaattcaagttcaggttcattaattaattcacttattccttcatttttcacttccagcatctacaccaccatgg

SEQ ID NO: 72 - DNA, 1178 bp, Oryza sativa
  misc_feature (1)..(1178): AF204063 3'-regulatory sequence engineered
  misc_feature (1)..(326): 3'-untranslated sequence
  misc_feature (327)..(1178): 3'-nontranscribed sequence
tgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccaaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctcaaaaacttgtggagattatgttagggagtagtgcaagaaatgttttaagacggcagctgttatctcatgagatattgataatgatgttgtctctgctgctgtcgcgatcgccaaattatgctgtttttttagattataccgaaatatgctgatggatacgtggttttgatctgtggccgttgcgaagtaagcgcgatttatttctgcaggcgttcgaatcacgttttactgttggcggtagttactgcacggtgactgttcgacgaaatgccaaaacaacccgcaggctgcagccagtcgacatgtgcggcggccgtcgcccgatcgcgcggctagctagtagctgtcggcaccgccggttggttacccgcaccaccgggccctcgccgtcgccgtcggccgtccttgcgctgcacggacgcgtcacgcgcactgccgcctgcctgcctttgcgctgtcgggcgggcgcgcgggcagaaagcgaccgcgcgcgcggaggggggcgccctcttccacacgcagcgatgcggaggcggcactggcacggaactcccaccgagccgacgggcccgcccgcccggcggccggccgcgccgcgccagcagctggacgaacatgcgtgcacagcgcgcgcgcaggcgaggcgcggcgcgacgtggtgcttcggctcgcgtcctcgcgtacgtacgccgccacggccaccaccgccatcagtgtcgcgttatgcacttactcatactgaacactggacagagcacgatatgcagcggtgtttgtaccgcccggcccaagggacggcagactcgccggcagaaaatcaaattaaaattgcaatgttgcaagtatatgcag

SEQ ID NO: 73 - DNA, 3979 bp, Oryza sativa
  misc_feature (1)..(3979): AF345911 5'-regulatory sequence
  misc_feature (1236)..(1546): Exon
  misc_feature (1547)..(3962): Intron
  misc_feature (1963)..(3979): Exon
gaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatccttg

SEQ ID NO: 74 - DNA, 1422 bp, Oryza sativa
  misc_feature (1)..(1422): AF345911 3'-regulatory sequence
  misc_feature (1)..(424): 3'-untranslated sequence
  misc_feature (425)..(1422): 3'-nontranscribed sequence
taagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttacagtttctcgcagaatcagaagctccccaaatagtctagcttttggtttagattctaataagttgtagtggtagaattcagaaaatgaactagaagccaaaagctggcaaacctagttttttcaaattctcagaagctggctaccaatcagttacttttcaaaatcttaagctcctccaaacaagctctaaaattacgttgaaagtgttgcttgtcgtaatagtgctgagggtagatgggctgtacaccccgaaaaagttttgcgcaaaacaaaacatactgtataaatgaaacaatttatattcgacaaaggaaacctagctattcaagggaataaatctataccgtacgagccaatttgataatctgttggtaaatgtcactactatatctaatttatcttgccatttaagtcaa

SEQ ID NO: 75 - DNA, 3980 bp, Oryza sativa
  misc_feature (1)..(3980): AF345911 5'-regulatory sequence engineered
gaaaatctcaaggtttcgaaaacgacatggtacgtcgtgcgcgtatatgtaactattgaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatcgggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatcgatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttagattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatcgacaaccaccatgg

SEQ ID NO: 76 - DNA, 1419 bp, Oryza sativa
  misc_feature (1)..(1419): AF345911 3'-regulatory sequence engineered
  misc_feature (1)..(421): 3'-untranslated sequence
  misc_feature (422)..(1419): 3'-nontranscribed sequence
gatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccaaggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttacagtttctcgcagaatcagaagctccccaaatagtctagcttttggtttagattctaataagttgtagtggtagaattcagaaaatgaactagaagccaaaagctggcaaacctagttttttcaaattctcagaagctggctaccaatcagttacttttcaaaatcttaagctcctccaaacaagctctaaaattacgttgaaagtgttgcttgtcgtaatagtgctgagggtagatgggctgtacaccccgaaaaagttttgcgcaaaacaaaacatactgtataaatgaaacaatttatattcgacaaaggaaacctagctattcaagggaataaatctataccgtacgagccaatttgataatctgttggtaaatgtcactactatatctaatttatcttgccatttaagtcaa

SEQ ID NO: 77 - DNA, 2300 bp, Oryza sativa
  misc_feature (1)..(2300): AF424549 5'-regulatory sequence
  misc_feature (1)..(1998): 5'-nontranscribed sequence
  misc_feature (1)..(2300): n is a, c, g, or t
  misc_feature (319)..(319): n is a, c, g, or t
  misc_feature (1999)..(2186): Exon
  misc_feature (2187)..(2287): Intron
  misc_feature (2288)..(2300): Exon
tacaaagtgctggaagtgatagtatgtgggcattaagtggtgcctggactagaaagttgcagcgagtgttttccacttgtgtccaatggcgcatgattgaccgtgtcgtcctcgtcgccgttgcatttatggaactgagctgcccatcccctctcctccgtagcaaaggcatcacagattcacaggtcgcccatcacgtcgatcgatcagtaactgttacagcaagcatgtagaatagccatttctgaacctgcgaggttgcatctatccatggttaaaacaagtcgccgtactacgaaccattggtgccatatgtccnttgattcgttgggggtgacatgactagtcacgagctgcctatatgtaacactagaagaggcttctagtggtcgtagtagcttggtttggttgctggacaatgagagttggtagcaagaggtgcaccctgctgtccccccggttcagggataaaatgaagcacaggctggaacttagattgtctagagatggtaattggtcaattggtgaagttgtgacttgtgattacgagcatcttgctcttgcaggacattgctctccccttcgctcgtaattggtagtttgttgtcattggccttgttttgatcctccgggctattaaatagctatccggaatcttgctatttaggattattaaacgtagattaccgacaaaaccgatcccataacccctagactattttgcgagacgaatctaatgatgtatattaatccataattagcggctgattactgtagcatcactgtagcaaatcatggattaatatacctcgttagattcgtttcgcaaaatagcctaggggttatggaatgagttttgtcagtattctaagtttaatactcttaaatagcaagatttcggagggctatttaatagccctccggatccaaacagggccattgtcttttaaaaacacctaggggtcttctggccagctccacgagatggtgggttagacggcctgggttcaaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaatggtgctaaccgttgggcggccagccacgcatgcagcgaatcggtcgatcgatcatgcagctgctaacacacacacaagagaagacgagacgaaactcagccggccggtgattcgatcgagagtaggtgacacagccaagcaggatagaggctatttttaggagagcttctagctgctgcaacttctctcagaattagaagctcccccaaacagtatatcttttggttcatattctaagaagttgtagttgtagaatccagaaagtgaaccagaagctagaagctgaaaaacctagcttttcaatattctcagaagctgtagttgtaaaatctagaaaatgaatcagaaaccaaaaaaatgaaaaatccagcttttctagattcttataaattgtctacaaatcagctgcttctcataattttaaactccacaaatactgcaggatccgtctccgcgaaccgagagacgttacggtatacggagtgggcacgattgctttcacgagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatggggaggggcaagatcgagatcaagcggatcgagaacgcgaccaacaggcaggtgacctactcgaagcgccgcacggggatcatgaagaaggccagggagctcaccgtgctctgcgacgcccaggtcgccatcatcatgttctcctccaccggcaagtaccacgagttctgcagcccttccaccgagtctgtatctccatctccacttcgactctatgatcttctccatcctgattatactatatatataactgcatcatatcgatcttaattgcatcctgctgcagcatcaaggggatc

SEQ ID NO: 78 - DNA, 1500 bp, Oryza sativa
  misc_feature (1)..(1500): AF424549 3'-regulatory sequence
  misc_feature (1)..(3): natural stop codon
  misc_feature (4)..(1500): 3'-nontranscribed sequence
tgagatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgccacgcttgctttattagctttgactatcaagctactgatcagagagttacctagctcaaaggattaattattatgtatacagctcaaatacattaatgggctactggctgctgctgtccgagtaattatttacacctgtggtatatcgcttagtccgttttgttgggattttgttgttggtcttatgtcatcttggtgtgttttgttgtttttttctctttatttgtgtgttttttctttggctctttggggaggtttttacctcctatgttctcttcttaatgaaatggcgcacaattcttttgcgattttgaggaaaaaaaaaagattacctccgtggccaatcagcaagctcgccctcgccggccggcgagggcgaggagatcgccgttgttggctgttgtttgggctggacagcccaacaattactgctcagtagcccactctgggtgaaagcccgctcagcccgatagagttaacttccgtgggccgatttgtcgcgcaaccaaggtggcccgctccgcctccttcgttgcacgtgggcccataccacggtgaaaccatgtgtgggccttagttgggcttaactctggcccattaataatcgctggacagcgtccatgctagctactgcatttcttttttcgatttcagtaccacggaaagctataagcatcaccagaatttggacgaaaattctatataaacatcaccttgaatttacacgaaaatttcacattttcaatgtatattcgtttaaaaatgtaatcaccgcaggttagtgcactacacagccaaggagataattgctgtaattaacaatgttatcctcgactaaattaaggtattaaattttctgtacgtactttcagtcgcctgttcaacatggaaattaagaaatgcaaagtagaagagacaaattaacagcggcttttggccgcctacttttcaagttcatgtgctaagcatatggcattgctaatcatggggtcgtattaaggaatcataatcatcatggtgatcatcatcatcacaaggtgattaattaaataataaagatttaaaggcggccggcaccagctgagactaagactgggctctgggctcaatcagacgcaccggactttcagctaaaagggcctcgtcaaaggtgcttgggcctcgccaagataataaaa

SEQ ID NO: 79 - DNA, 2301 bp, Oryza sativa
  misc_feature (1)..(2301): AF424549 5'-regulatory sequence engineered
  misc_feature (1)..(2301): n is a, c, g, or t
  misc_feature (319)..(319): n is a, c, g, or t
tacaaagtgctggaagtgatagtatgtgggcattaagtggtgcctggactagaaagttgcagcgagtgttttccacttgtgtccaatggcgcatgattgaccgtgtcgtcctcgtcgccgttgcatttatggaactgagctgcccatcccctctcctccgtagcaaaggcatcacagattcacaggtcgcccatcacgtcgatcgatcagtaactgttacagcaagcatgtagaatagccatttctgaacctgcgaggttgcatctatccatcgttaaaacaagtcgccgtactacgaaccattggtgccatatgtccnttgattcgttgggggtgacatgactagtcacgagctgcctatatgtaacactagaagaggcttctagtggtcgtagtagcttggtttggttgctggacaatgagagttggtagcaagaggtgcaccctgctgtccccccggttcagggataaaatgaagcacaggctggaacttagattgtctagagatggtaattggtcaattggtgaagttgtgacttgtgattacgagcatcttgctcttgcaggacattgctctccccttcgctcgtaattggtagtttgttgtcattggccttgttttgatcctccgggctattaaatagctatccggaatcttgctatttaggattattaaacgtagattaccgacaaaaccgatcccataacccctagactattttgcgagacgaatctaatgatgtatattaatccataattagcggctgattactgtagcatcactgtagcaaatcatggattaatatacctcgttagattcgtttcgcaaaatagcctaggggttatggaatgagttttgtcagtattctaagtttaatactcttaaatagcaagatttcggagggctatttaatagccctccggatccaaacagggccattgtcttttaaaaacacctaggggtcttctggccagctccacgagatggtgggttagacggcctgggttcaaaacctcaccccttctaattatttgatattatgtcattttctaatattcgcgtctgttttgttgtcatcgtctttctaagcgtgcgtgcttgcaaaggaaaggagtagagagagagagaggcacatcagcagatcgagagagagaagctggtatgacaaaagaaaagaaaagacagaagatgactcatgcacacttgcgaaatcaaaccaaaagagaatcaaagcgaggcaatatgtacgcgcagaagcaatgatgaagcgaaagccgaaatggtgctaaccgttgggcggccagccacgcatgcagcgaatcggtcgatcgatcatgcagctgctaacacacacacaagagaagacgagacgaaactcagccggccggtgattcgatcgagagtaggtgacacagccaagcaggatagaggctatttttaggagagcttctagctgctgcaacttctctcagaattagaagctcccccaaacagtatatcttttggttcatattctaagaagttgtagttgtagaatccagaaagtgaaccagaagctagaagctgaaaaacctagcttttcaatattctcagaagctgtagttgtaaaatctagaaaatgaatcagaaaccaaaaaaatgaaaaatccagcttttctagattcttataaattgtctacaaatcagctgcttctcataattttaaactccacaaatactgcaggatccgtctccgcgaaccgagagacgttacggtatacggagtgggcacgattgctttcacgagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggcgatggggaggggcaagatcgagatcaagcggatcgagaacgcgaccaacaggcaggtgacctactcgaagcgccgcacggggatcatcaagaaggccagggagctcaccgtgctctgcgacgcccaggtcgccatcatcaagttctcctccaccggcaagtaccacgagttctgcagcccttccaccgagtctgtatctccatctccacttcgactctatgatcttctccatcctgattatactatatatataactgcatcatatcgatcttaattgcatcctgctgcagcatcaccaccatgg

SEQ ID NO: 80 - DNA, 1497 bp, Oryza sativa
  misc_feature (1)..(1497): AF424549 3'-regulatory sequence engineered
gatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgccacgcttgctttattagctttgactatcaagctactgatcagagagttacctagctcaaaggattaattattatgtatacagctcaaatacattaatgggctactggctgctgctgtccgagtaattatttacacctgtggtatatcgcttagtccgttttgttgggattttgttgttggtcttatgtcatcttggtgtgttttgttgtttttttctctttatttgtgtgttttttctttggctctttggggaggtttttacctcctatgttctcttcttaatgaaatggcgcacaattcttttgcgattttgaggaaaaaaaaaagattacctccgtggccaatcagcaagctcgccctcgccggccggcgagggcgaggagatcgccgttgttggctgttgtttgggctggacagcccaacaattactgctcagtagcccactctgggtgaaagcccgctcagcccgatagagttaacttccgtgggccgatttgtcgcgcaaccaaggtggcccgctccgcctccttcgttgcacgtgggcccataccacggtgaaaccatgtgtgggccttagttgggcttaactctggcccattaataatcgctggacagcgtccatgctagctactgcatttcttttttcgatttcagtaccacggaaagctataagcatcaccagaatttggacgaaaattctatataaacatcaccttgaatttacacgaaaatttcacattttcaatgtatattcgtttaaaaatgtaatcaccgcaggttagtgcactacacagccaaggagataattgctgtaattaacaatgttatcctcgactaaattaaggtattaaattttctgtacgtactttcagtcgcctgttcaacatggaaattaagaaatgcaaagtagaagagacaaattaacagcggcttttggccgcctacttttcaagttcatgtgctaagcatatggcattgctaatcatggggtcgtattaaggaatcataatcatcatggtgatcatcatcatcacaaggtgattaattaaataataaagatttaaaggcggccggcaccagctgagactaagactgggctctgggctcaatcagacgcaccggactttcagctaaaagggcctcgtcaaaggtgcttgggcctcgccaagataataaaa

SEQ ID NO: 81 - DNA, 5900 bp, Oryza sativa
  misc_feature (1)..(5900): AJ293816 5'-regulatory sequence
  misc_feature (1)..(1856): 5'-nontranscribed sequence
  misc_feature (1)..(5900): n is a, c, g, or t
  misc_feature (203)..(203): n is a, c, g, or t
  misc_feature (244)..(244): n is a, c, g, or t
  misc_feature (492)..(492): n is a, c, g, or t
  misc_feature (1793)..(1793): n is a, c, g, or t
  misc_feature (1857)..(2095): Exon
  misc_feature (2096)..(5583): Intron
  misc_feature (3710)..(3711): n is a, c, g, or t
  misc_feature (5584)..(5900): Exon
caaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggngtaacaagtttcccaaacaattaagcttttcgtccagattntaagaagttgaagtcagagtctaaaaaacaaactagaagtataaggtgtgaaacctagttttttagattatcagaagatgactatcaaatgctccctccgtcaaaaaaaaaagcaacctagagccacatctccttctagtagtacaaacgaatctgaacaaccctcctagatccacatctcctcctaaattgtctttttttttggacgaatcggggggtaccccatatgtcaaaaaggaattcaactntacggatgaatctgaacatatggattttcttttaatggaaagggtataattaccccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcggaattggccgccgccgcagccatagatctgcggcgccgcgtatctcgcggctggtttggctggtgcggttagcggctagggttttggtngtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcattttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaaatatatatatatatattcaattctgttgcttttgtcacgaatagttgttagttttaacgcgagcgtgcttaaactgaccattnnttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctctcagtataaaaagcagcctctacataatttaaaaagtgcaaatactagtgtgatagtaaacaaataaataacattagagtttgtgtattatggatgagatatattgtactacctttgtctctaaatacaaaagattttgcttatgtagatatatatatgggcaaaatctcttaagatgaaggtagtacacatgttttatatatatatatacacctcctgatcgaatcgatgaggagatatgagggataaaattaaaggcggtagacatctctattattaaacttggctagcactactactagtctacatgtataaacatgaaaccattaatcacacacacagagagataaaagaaaaaaaacaagaaaacaacagaaatgactgcttaaatggagcatatatagaaaaaacataatataattattggaagatagatagatgcaaagaatattttctaaaagattggacctcaagttaaaagttctctaatatccctatgattcgagccaaccataaggaatttcataggaatttggaatgactattccttcgttccgattagacatatatatagggttttctcaactttataaaatttatttaaatttcctttgtttgaaaagagccataagatatagtactagttcatcatgtcataatacataacaagaaccataagatatagtcatgtgtcttcgtcttctagacttctactattcctgctgcctgtgccatgtcatgcatgcatggtccatgcatgaaatattgatggccacagaacaagctacgcgtggcttacctcttcacagaagcaattgtattttcttcttctcgttctctgaaacaatcaatatggtagttcagaacattcatatccttccaatatggtagttcagaagcaattgtattttgaagggcctagaagaactacctaacaatatttggtactactagcatcttgatgaaaacgtttggattcaacattacaaaccttagctagctctacaaacatccaactctgtctaactttgttttctatatatacattgatgaagcatggaacagattattg

SEQ ID NO: 82 - DNA, 1297 bp, Oryza sativa
  misc_feature (1)..(1297): 3'-regulatory sequence
  misc_feature (1)..(297): 3'-untranslated sequence
  misc_feature (298)..(1297): 3'-nontranscribed sequence
tgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtaaagctttcagttttgttgattctggctgtcagattaaacaatgcaagtagtactgagatgaaaaaaaaagttaactttagccctgcttcgattttctttggccttttcaaattttaatctttctgaagaagttagtgtaggttagcagaatggcagagcagaggaatgttctagtagagcggaaattcagtaaaaaattcagttttgttgaatgtgactatcagattaaacatgtagccatcagtactgaggtaaaaaagttagctttagcctgcttcgattttctttagcctttgcaagttttaagctactgaagaagttagggcatgcatggttagcagaacggcagagcagagcagatgaatgcaggatgatgcagaggagagccagggccgaaatgtttcaaa

SEQ ID NO: 83 - DNA, 5901 bp, Oryza sativa
  misc_feature (1)..(5901): AJ293816 5'-regulatory sequence engineered
  misc_feature (1)..(5901): n is a, c, g, or t
  misc_feature (203)..(203): n is a, c, g, or t
  misc_feature (244)..(244): n is a, c, g, or t
  misc_feature (492)..(492): n is a, c, g, or t
  misc_feature (1793)..(1793): n is a, c, g, or t
  misc_feature (3710)..(3711): n is a, c, g, or t
caaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggngtaacaagtttcccaaacaattaagcttttcgtccagattntaagaagttgaagtcagagtctaaaaaacaaactagaagtataaggtgtgaaacctagttttttagattatcagaagatgactatcaaatgctccctccgtcaaaaaaaaaagcaacctagagccacatctccttctagtagtacaaacgaatctgaacaaccctcctagatccacatctcctcctaaattgtctttttttttggacgaatcggggggtaccccatatgtcaaaaaggaattcaactntacggatgaatctgaacatatggattttcttttaatggaaagggtataattaccccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcggaattggccgccgccgcagccatagatctgcggcgccgcgtatctcgcggctggtttggctggtgcggttagcggctagggttttggtngtttcgtctgatcgatcctccccgattttgcggcggcggtggtgaattggtgtgtgatctgataaggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcattttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaaatatatatatatatattcaattctgttgcttttgtcacgaatagttgttagttttaacgcgagcgtgcttaaactgaccattnnttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctctcagtataaaaagcagcctctacataatttaaaaagtgcaaatactagtgtgatagtaaacaaataaataacattagagtttgtgtattatggatgagatatattgtactacctttgtctctaaatacaaaagattttgcttatgtagatatatatatgggcaaaatctcttaagatgaaggtagtacacatgttttatatatatatatacacctcctgatcgaatcgatgaggagatatgagggataaaattaaaggcggtagacatctctattattaaacttggctagcactactactagtctacatgtataaacatgaaaccattaatcacacacacagagagataaaagaaaaaaaacaagaaaacaacagaaatgactgcttaaatggagcatatatagaaaaaacataatataattattggaagatagatagatgcaaagaatattttctaaaagattggacctcaagttaaaagttctctaatatccctatgattcgagccaaccataaggaatttcataggaatttggaatgactattccttcgttccgattagacatatatatagggttttctcaactttataaaatttatttaaatttcctttgtttgaaaagagccataagatatagtactagttcatcatgtcataatacataacaagaaccataagatatagtcatgtgtcttcgtcttctagacttctactattcctgctgcctgtgccatgtcatgcatgcatggtccatgcatgaaatattgatggccacagaacaagctacgcgtggcttacctcttcacagaagcaattgtattttcttcttctcgttctctgaaacaatcaatatggtagttcagaacattcatatccttccaatatggtagttcagaagcaattgtattttgaagggcctagaagaactacctaacaatatttggtactactagcatcttgatgaaaacgtttggattcaacattacaaaccttagctagctctacaaacatccaactctgtctaactttgttttctatatatacattgatgaagcatcgaacaccaccatgg

SEQ ID NO: 84 - DNA, 1294 bp, Oryza sativa
  misc_feature (1)..(1294): AJ293816 3'-regulatory sequence engineered
  misc_feature (1)..(294): 3'-untranslated sequence
  misc_feature (295)..(1294): 3'-nontranscribed sequence
tggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtaaagctttcagttttgttgattctggctgtcagattaaacaatgcaagtagtactgagatgaaaaaaaaagttaactttagccctgcttcgattttctttggccttttcaaattttaatctttctgaagaagttagtgtaggttagcagaatggcagagcagaggaatgttctagtagagcggaaattcagtaaaaaattcagttttgttgaatgtgactatcagattaaacatgtagccatcagtactgaggtaaaaaagttagctttagcctgcttcgattttctttagcctttgcaagttttaagctactgaagaagttagggcatgcatggttagcagaacggcagagcagagcagatgaatgcaggatgatgcagaggagagccagggccgaaatgtttcaaa

SEQ ID NO: 85 - DNA, 1947 bp, Oryza sativa
  misc_feature (1)..(1947): AY115556 5'-regulatory sequence
  misc_feature (1)..(1399): 5'-nontranscribed sequence
  misc_feature (1400)..(1838): Exon
  misc_feature (1839)..(1931): Intron
  misc_feature (1932)..(1947): Exon
gatataaaaacctactttatgttcatgtcaggatgtattttcgacgaggaaacatcattttcatggacaaggtactctcttccacagaatgccttgtcaatgtattcctctcaagttcaagctgtagttttttcagtgagtacttatgccatttcctgtgggccaaaagggaaatttgccaagggtgatagagatgaaaaccttgtgagagcactaacaagtgagggatttaaaatggcagagaatcatttgggattgcaaattgttgggtaaagatgctttgtgcagcaaaagagagaggggaggagaaaaagaggggttattgacatgacaccaaatgggcatcatgttttaattaagctagcaaagctagccatctttttaacaagacaaatggtcgtaaagcaaaatggaggaggaattttgtagccattaggcacccaatttcagttttatttgtgcggccataaagccaacaaaatcacaataccaaggcgcccctggctcttatctcaattttcttttgtttcaagttctttatttcttatcttaatctaagcttcaccagaacattaggtgcaagatttattttatctccgcatttaggtaatagatttagctgatttctcgcattaagaagacctaatttgcatgcaactcctgagcctgaacatttattcaggaattgaactacattactgaccagttacccatcagatgctagcacataattaagctataaccaacttgttaacatcaaattaatcagccaatcacaatctctcaaactacacggactcaatgattgggctgctaactagttagttaaacacctggtcctggtgcacaacacaaaagagcataaatgatgtgtttctgaatccaattacacacatgatatgcaggggaccatcagaagttgcagtcatctcatctgaactgaaaccttttcagtgaacgatgctgtcatctgaaaccttggatcccaattcccagcttgtatgcatgtctgtaaatgaatatgcatcttgacctgatgagctatttgctagatgttcccatccacacgtcccgtccaatggacggaccagatcggatgatttttagccatcaggaaagcagcatgatgcacgcatggttgttatgcaaatgtgcaaatgcaaaagttggccgcaagaacagcacatacatatatactactactccagttccctagctagatatcgccaagtgtaaagctagaaatatatgcgtgcatcgtcccgacaaaaaacaaataatattctccatttccctggacagagaaagagagagagagaattctagtgtgagttgagtgagatagtgtgtggagcatctgctatataaaagggagagttgtagtgtgagttgtggtaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacgggaagctctacgacctcgccaccaccgggtaccttcagcttcttctccatcaaatcaaattaaaaaaggttttgagcttagctctgatataccatggaggttaattgatttctttgaacagaaccatggaggagctg

SEQ ID NO: 86 - DNA, 994 bp, Oryza sativa
  misc_feature (1)..(994): AY115556 3'-regulatory sequence
  misc_feature (1)..(246): 3'-untranslated sequence
  misc_feature (247)..(994): 3'-nontranscribed sequence
taacactaataatggcctgggggatacttgtgttcattactagtgtgtaatatggttaataatgcttgtgttgctgtttgctttgctattctgatgtaccttatttagacaagttcccgcaggaagtgtcttttagtattgtatttgtcttgggctgtggtgctttgtttttccctaaagaactcttgaggagctctgttgttgaaccatttcaagtaattgagactattgtttcctggaacgtttattacatttgtagaattaagcatttttttatcggatttcagtttacaagtttaagcttgcaaaatctacctaaatatctggtttcagtttgccaagtttaagctcgcaaaatctatctaaatatatggtttcagtttgccaggtttaagctcacaaaatctatgtgcaaataataactgtaaatatcaaagtgatgaggtcatgctaggaaaactattaacactgtcaaattgcgctgaaactcaatgcttatatcacctttccagcgctctccacccatattacacaaaaattaactctaacagtaagtatggtacagaaaataaaagaagacctacaaccaagatcagaaaatgaactactcgagtcctttggcaacatgtacatatgaaatgttgatgtttacacaacattgctcaggatgcagcacaatgccatgatagcaccatacatggtagtaaaagaatggaagaaaaatatatgcattttaaataccatgcaagaaatggcaattccagcgctatatcatcatacattaatggtcgaccttcattggaatcaagatcattgatgcattggaagtaactacaacgtcaaaagtttaggccctcataaccgatgatcacttaggatgcgttgagatagactaacaggagaaaaaaacaagtttgatcacattatgaagcctttattatctttaaaatagagtagtacttccgagatgcaatttaatcattcgtgcaaagtt

SEQ ID NO: 87 - DNA, 1948 bp, Oryza sativa
  misc_feature (1)..(1948): AY115556 5'-regulatory sequence engineered
gatataaaaacctactttatgttcatgtcaggatgtattttcgacgaggaaacatcattttcatggacaaggtactctcttccacagaatgccttgtcaatgtattcctctcaagttcaagctgtagttttttcagtgagtacttatgccatttcctgtgggccaaaagggaaatttgccaagggtgatagagatgaaaaccttgtgagagcactaacaagtgagggatttaaaatggcagagaatcatttgggattgcaaattgttgggtaaagatgctttgtgcagcaaaagagagaggggaggagaaaaagaggggttattgacatgacaccaaatgggcatcatgttttaattaagctagcaaagctagccatctttttaacaagacaaatggtcgtaaagcaaaatggaggaggaattttgtagccattaggcacccaatttcagttttatttgtgcggccataaagccaacaaaatcacaataccaaggcgcccctggctcttatctcaattttcttttgtttcaagttctttatttcttatcttaatctaagcttcaccagaacattaggtgcaagatttattttatctccgcatttaggtaatagatttagctgatttctcgcattaagaagacctaatttgcatgcaactcctgagcctgaacatttattcaggaattgaactacattactgaccagttacccatcagatgctagcacataattaagctataaccaacttgttaacatcaaattaatcagccaatcacaatctctcaaactacacggactcaatgattgggctgctaactagttagttaaacacctggtcctggtgcacaacacaaaagagcataaatgatgtgtttctgaatccaattacacacatgatatgcaggggaccatcagaagttgcagtcatctcatctgaactgaaaccttttcagtgaacgatgctgtcatctgaaaccttggatcccaattcccagcttgtatgcatgtctgtaaatgaatatgcatcttgacctgatgagctatttgctagatgttcccatccacacgtcccgtccaatggacggaccagatcggatgatttttagccatcaggaaagcagcatgatgcacgcatggttgttatgcaaatgtgcaaatgcaaaagttggccgcaagaacagcacatacatatatactactactccagttccctagctagatatcgccaagtgtaaagctagaaatatatgcgtgcatcgtcccgacaaaaaacaaataatattctccatttccctggacagagaaagagagagagagaattctagtgtgagttgagtgagatagtgtgtggagcatctgctatataaaagggagagttgtagtgtgagttgtggtaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatcgcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacgggaagctctacgacctcgccaccaccgggtaccttcagcttcttctccatcaaatcaaattaaaaaaggttttgagcttagctctgatatagcatggaggttaattgatttctttgaacagaaccatcgccaccatgg

SEQ ID NO: 88 - DNA, 991 bp, Oryza sativa
  misc_feature (1)..(991): AY115556 3'-regulatory sequence engineered
  misc_feature (1)..(243): 3'-untranslated sequence
  misc_feature (244)..(991): 3'-nontranscribed sequence
cactaataatggcctgggggatacttgtgttcattactagtgtgtaatatggttaataatgcttgtgttgctgtttgctttgctattctgatgtaccttatttagacaagttcccgcaggaagtgtcttttagtattgtatttgtcttgggctgtggtgctttgtttttccctaaagaactcttgaggagctctgttgttgaaccatttcaagtaattgagactattgtttcctggaacgtttattacatttgtagaattaagcatttttttatcggatttcagtttacaagtttaagcttgcaaaatctacctaaatatctggtttcagtttgccaagtttaagctcgcaaaatctatctaaatatatggtttcagtttgccaggtttaagctcacaaaatctatgtgcaaataataactgtaaatatcaaagtgatgaggtcatgctaggaaaactattaacactgtcaaattgcgctgaaactcaatgcttatatcacctttccagcgctctccacccatattacacaaaaattaactctaacagtaagtatggtacagaaaataaaagaagacctacaaccaagatcagaaaatgaactactcgagtcctttggcaacatgtacatatgaaatgttgatgtttacacaacattgctcaggatgcagcacaatgccatgatagcaccatacatggtagtaaaagaatggaagaaaaatatatgcattttaaataccatgcaagaaatggcaattccagcgctatatcatcatacattaatggtcgaccttcattggaatcaagatcattgatgcattggaagtaactacaacgtcaaaagtttaggccctcataaccgatgatcacttaggatgcgttgagatagactaacaggagaaaaaaacaagtttgatcacattatgaagcctttattatctttaaaatagagtagtacttccgagatgcaatttaatcattcgtgcaaagtt

SEQ ID NO: 89 - DNA, 2753 bp, Oryza sativa
  misc_feature (1)..(2753): AY177695 5'-regulatory sequence
  misc_feature (1)..(1799): 5'-nontranscribed sequence
  misc_feature (1800)..(2145): Exon
  misc_feature (2146)..(2737): Intron
  misc_feature (2738)..(2753): Exon
tcagtccatcatttcgtctacaactaattataagccataatgctcattagcaacaaaaaaaattatagtaaaacttttacatatgtgttcttgacgacttaaaagtcaatattgaaaataaactgtgttgaataaacattaaaatcaattctaaaattaagttttaaaatatttaaattttggttgcagcaaagctgaagagcaaaccatggagctaacaaacacatgtataattgactggttgccaatttacattttccgcctcctaataagctagcatttaatattgtagcacccacagatagtcatccggaaagcagtaaaccagaaaccagacacattttgtgggatggtggcaaaatgtgtataaaaccaacgggaagcacatagctagcacacgaatttaggtacctataacctgccctcctcatatcatgtcatatgcgagataccaccaaatagaaaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacaccatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaaggttggtgattatcatcgtcgatccccttctatagttctatatgtatatagctgctacctgctaggtcatgaaatatatcccaatccttcagatttttgtctatatatctcgatgtgtccagctatctagcttttgctttactctagcttagggttttctttgattctttggatgatcttaaggtgaaagacttctgttttttttagaaaaaaataaagaaaatcgatgcatccatttagatcactccttctcccatctaaataatctctatacactattaatttgatgaattgtgtatgcatatattgactctttctgtttagtctggagcattattcctgaaagagaaggagatgcgcagtaggagctggtatgcaaggggctgccagaatgtgagaatatatttctagaaatggtgtatacgatttttctaagttaaataactcacaagttatctctagatatatatttattttgatttgtatattaatttacctcgtttcttagctgaaaatttaggttaatttcccctagatgcataaaacatttgctatatattggatcgtaatggtatagtcttcctttttgttagcatgaaatcaataata

SEQ ID NO: 90 - DNA, 1340 bp, Oryza sativa
  misc_feature (1)..(1340): AY177695 3'-regulatory sequence
  misc_feature (1)..(26): 3'-untranslated sequence
  misc_feature (27)..(582): Intron
  misc_feature (583)..(818): Exon
  misc_feature (819)..(1340): 3'-nontranscribed sequence
taacacatgatcaagtgttaaaaacagtgagttttcaaatctttaattacgtaaaccgtaaaacctcgctcttgtaactaatatatatttcttcaatgtttaatcaaagttgtcagagttccttaccttttgctagtatcacaaaacaagtagctatttgtttgtgatactagctagtaatttgtgttaagctagctagtaacttgtgttaaactagctatataaattaagtcacaaaatacccataaattaagctagctagcccttcaaattttgttgtttttctctgattagttaatactatggtttctagctagctagctagctagcccttcaaattaagcactgtacagaacttgttaattttctactcatctttactagtataaattatgccactaattaagttcctagagttacttttcatgttcagaagttgcatgcatgcatggcaagttactttaattactgtgctcttgtttaaagaaaagtgttaactttattctaaaaaaaaagtgttaactttacagttacacagatatgtccctcattagaaggtgtaataaatctgtttgtttgcagacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagcc

SEQ ID NO: 91 - DNA, 2754 bp, Oryza sativa
  misc_feature (1)..(2754): AY177695 5'-regulatory sequence engineered
tcagtccatcatttcgtctacaactaattataagccataatgctcattagcaacaaaaaaaattatagtaaaacttttacatatgtgttcttgacgacttaaaagtcaatattgaaaataaactgtgttgaataaacattaaaatcaattctaaaattaagttttaaaatatttaaattttggttgcagcaaagctgaagagcaaaccatcgagctaacaaacacatgtataattgactggttgccaatttacattttccgcctcctaataagctagcatttaatattgtagcacccacagatagtcatccggaaagcagtaaaccagaaaccagacacattttgtgggatggtggcaaaatgtgtataaaaccaacgggaagcacatagctagcacacgaatttaggtacctataacctgccctcctcatatcatgtcatatgcgagataccaccaaatagaaaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacacgatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagaaggggagagggaagattgccatcaagaggatcgacaacacgaagaaccggcaggtgaccttctcgaagcggcgcggcgggctgatcaagaaggcccgggagctggccatcctctgcgacgccgacgtcggcctcattgtcttctcctgcaccggccgcctctacgacttctccagctcaaggttggtgattatcatcgtcgatccccttctatagttctatatgtatatagctgctacctgctaggtcatgaaatatatcccaatccttcagatttttgtctatatatctcgatgtgtccagctatctagcttttgctttactctagcttagggttttctttgattctttggatgatcttaaggtgaaagacttctgttttttttagaaaaaaataaagaaaatcgatgcatccatttagatcactccttctcccatctaaataatctctatacactattaatttgatgaattgtgtatgcatatattgactctttctgtttagtctggagcattattcctgaaagagaaggagatgcgcagtaggagctggtatgcaaggggctgccagaatgtgagaatatatttctagaaatggtgtatacgatttttctaagttaaataactcacaagttatctctagatatatatttattttgatttgtatattaatttacctcgtttcttagctgaaaatttaggttaatttcccctagatgcataaaacatttgctatatattggatcgtaatggtatagtcttcctttttgttagcatcaaatccaccatgg

SEQ ID NO: 92 - DNA, 1337 bp, Oryza sativa
  misc_feature (1)..(1337): AY177695 3'-regulatory sequence
  misc_feature (1)..(23): 3'-untranslated sequence
  misc_feature (24)..(579): Intron
  misc_feature (580)..(815): Exon
  misc_feature (816)..(1337): 3'-nontranscribed sequence
cacatgatcaagtgttaaaaacagtgagttttcaaatctttaattacgtaaaccgtaaaacctcgctcttgtaactaatatatatttcttcaatgtttaatcaaagttgtcagagttccttaccttttgctagtatcacaaaacaagtagctatttgtttgtgatactagctagtaatttgtgttaagctagctagtaacttgtgttaaactagctatataaattaagtcacaaaatacccataaattaagctagctagcccttcaaattttgttgtttttctctgattagttaatactatggtttctagctagctagctagctagcccttcaaattaagcactgtacagaacttgttaattttctactcatctttactagtataaattatgccactaattaagttcctagagttacttttcatgttcagaagttgcatgcatgcatggcaagttactttaattactgtgctcttgtttaaagaaaagtgttaactttattctaaaaaaaaagtgttaactttacagttacacagatatgtccctcattagaaggtgtaataaatctgtttgtttgcagacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagcc

SEQ ID NO: 93 - DNA, 2519 bp, Oryza sativa
  misc_feature (1)..(2519): AY177696 5'-regulatory sequence
  misc_feature (1)..(1450): 5'-nontranscribed sequence
  misc_feature (1451)..(1632): Exon
  misc_feature (1633)..(2504): Intron
  misc_feature (2505)..(2519): Exon
caagcaaagaaacaaatttcgcaattagggtttttaagagataattttcccgctaggcgccacgacggaacgggcgctacagggtgtgttccttctccaaatatgcccttaatgttcagttttatttggcaactaattaaaccaagcatatatatactacctccggccagttttatttgtggttttggacaaactatattgataaagaatatgttgatagtactttatgcttgcctatggacaagtatttgtggtagtcaaaagtatgacattggaatacctcgctcaccgttgaacacaaccgtgagttagctgaccagactcatccgtgacccacacaaactataggttccatgaattaattccgatgccctttgccatctgcatacgcttcctactttatcttaaagaaattccatagtttaccaataggctctcttacttgaaaaaataggtcttttttttcgatttctattgagtagaggtttttctttttgttttctttttctggatttgtatgccatgcattctcccactgttctttttagtatcgttgatgattaatctccaaaaatatatcttttaccattattttctaatcatttgtttgtaggagttactaaaagtttactaatatcattctcatatatacatcaaatcttaattaaatgaatgaatttctatattgtcgatttaagtttttgatatctgattatgtgaatgccaaaatgacatctactaaaatctcaaacattggtgaggatgagacatcatctagtacaacgaatctggataaatagctagctcatgtctcatcctcactaaggttgttttttttgggacaaatggagtatttgtgaacgaaagaaggccaagcatgcacttaatcaccacctttcgtgcgtgcaacgatttttctcttggctctagctaacctaagccgggacacttttaacaggccttttaaatggcatccagccataaattaaactaatcgccaatatcaggcagcagccaattgggcgctgtctcctctttcctctcttccccctcccccttgcgtttcattgctaaataaagcaagtcgctggcaatttgaggaaagtccacccataccctgcaagttgcatccaccaccagaaaaagcctctcccgcaaacgccacacaccaaaccacaattaatcccatcaaattcccctataagctttggcctctttgcagctttcttctaccagctcccagctagatcccctcttgccttctttggcacattcgttcttgctctctgctgtggattatttgcctccggctccggccaatcggcggcgtggcgcgggcagatcgatcgatctcatcggcggcggggattgcctgttctagctatagcttgatagcttagctagcttggtcatttctggtgagagatcgatcgagatagcggcgaagaagatggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccaggtctgttctgttcttcatatcatcgatcatccgtcctctctccttgcttgcttgttgcttgttgatgattaacttttgcttgaagataatatttgttattgattcttgttcttttcctgcgcttagctttttctgctttaatttcctagtattttgatatttagccagggagccagcatgggccatggccagctcttctctgtgcagtcagaaagatgcataaactatgcaaaaactgccctcttattgagaaaagaaataaactatgcaaaaaccgtatatagacattcatgcacctaactaaaaaatggttatcacatatatataagagctgcacggagtaatgattatatatgtttttgtctttatttttcttttgaaggagatctgtatgtgtagttcttctatctaatttatcttttgttttgcatatgtatattttttttcttccttgttcttgactactaattaattaattaattgcaaaactaaacattgtctttggtttgtattaatttgtatattacttggccgtacgttatcatgtgatcaacatatatgcattgcagaaaccatcaaatgaaagaatatgtggtgaatggcagctaaaaaaatgatctagggtttcgtgataatatgaagtgtatagtgtgtgtctctaaatgaaaatttgtattacttcgatctctcagctgtgaataattgcgtgggtctatacatctcaactaccaattaggaggtgtgttagatggatgcttatttcttggtcaaaaaataacacataaaaatcacatgattcacatatatgatgtgtaatcttaattaacagattaaattttgttacttaccgttatatatatgcaaatatgcagcatgaagtcagttat

SEQ ID NO: 94 - DNA, 763 bp, Oryza sativa
  misc_feature (1)..(763): AY177696 3'-regulatory sequence
  misc_feature (1)..(265): 3'-untranslated sequence
  misc_feature (266)..(763): 3'-nontranscribed sequence
tgaccagaaaaacattgttttgctacacccttgtatgctgaagggatactatttgctgtcaagagttgatactcagatcaagaaaaaaaaaactattcatgccatagtgattgagaaatggacttgtatactggaaataaatgccacagtggaattgagttgtggaatccaggcaatgagtgttttatgattcaatttttccatgtatttttcatatattaaccagtgcgggcttgtgtaaaaaatataaccaggcaaggaaaattagctgtattgtgcatatggagcaaatttcaggcgttactaccattaaaatcatgacatgctgtaagcaaatatcttgtagacctttatctacatagatttttttcagtaggggcctccctaccgtttcaaaagaaaaagaatgcagatgattgatatttcgaatgccttcagacatggataattcataactattgcgatgtggaaccttcttaattttcaatttttaacacgctatctacaagtggaatatcataatcatttgcttgtcttcattagtaagacaagtttgaatgcacgtgccaatgtgagacaaccgtaccatataacggccattagtgctagattggctttgcaccatgaaaacattggttttacaacctactgtgaggacattaaaagcagagatactctagctggcctgtttggagataaacagtcgagaaatattgtgaagacaatcaaagtgtttattcctgggatgcagtccaatcccaaa

SEQ ID NO: 95 - DNA, 2520 bp, Oryza sativa
  misc_feature (1)..(2520): AY177696 5'-regulatory sequence engineered
caagcaaagaaacaaatttcgcaattagggtttttaagagataattttcccgctaggcgccacgacggaacgggcgctacagggtgtgttccttctccaaatatgcccttaatgttcagttttatttggcaactaattaaaccaagcatatatatactacctccggccagttttatttgtggttttggacaaactatattgataaagaatatgttgatagtactttatgcttgcctatggacaagtatttgtggtagtcaaaagtatgacattggaatacctcgctcaccgttgaacacaaccgtgagttagctgaccagactcatccgtgacccacacaaactataggttccatgaattaattccgatgccctttgccatctgcatacgcttcctactttatcttaaagaaattccatagtttaccaataggctctcttacttgaaaaaataggtcttttttttcgatttctattgagtagaggtttttctttttgttttctttttctggatttgtatgccatgcattctcccactgttctttttagtatcgttgatgattaatctccaaaaatatatcttttaccattattttctaatcatttgtttgtaggagttactaaaagtttactaatatcattctcatatatacatcaaatcttaattaaatgaatgaatttctatattgtcgatttaagtttttgatatctgattatgtgaatgccaaaatgacatctactaaaatctcaaacattggtgaggatgagacatcatctagtacaacgaatctggataaatagctagctcatgtctcatcctcactaaggttgttttttttgggacaaatggagtatttgtgaacgaaagaaggccaagcatgcacttaatcaccacctttcgtgcgtgcaacgatttttctcttggctctagctaacctaagccgggacacttttaacaggccttttaaatggcatccagccataaattaaactaatcgccaatatcaggcagcagccaattgggcgctgtctcctctttcctctcttccccctcccccttgcgtttcattgctaaataaagcaagtcgctggcaatttgaggaaagtccacccataccctgcaagttgcatccaccaccagaaaaagcctctcccgcaaacgccacacaccaaaccacaattaatcccatcaaattcccctataagctttggcctctttgcagctttcttctaccagctcccagctagatcccctcttgccttctttggcacattcgttcttgctctctgctgtggattatttgcctccggctccggccaatcggcggcgtggcgcgggcagatcgatcgatctcatcggcggcggggattgcctgttctagctatagcttgatagcttagctagcttggtcatttctggtgagagatcgatcgagatagcggcgaagaagatcgggagggggaagattgtgatccgccggatcgacaactcgacgagccggcaggtgacgttctcgaagcggaggaacgggatcttcaagaaggccaaggagctggccatcctctgcgacgccgaggtcggcctcaagatcttctccagcaccggccgcctctacgagtactccagcaccaggtctgttctgttcttcatatcatcgatcatccgtcctctctccttgcttgcttgttgcttgttgatgattaacttttgcttgaagataatatttgttattgattcttgttcttttcctgcgcttagctttttctgctttaatttcctagtattttgatatttagccagggagccagcatgggccatcgccagctcttctctgtgcagtcagaaagatgcataaactatgcaaaaactgccctcttattgagaaaagaaataaactatgcaaaaaccgtatatagacattcatgcacctaactaaaaaatggttatcacatatatataagagctgcacggagtaatgattatatatgtttttgtctttatttttcttttgaaggagatctgtatgtgtagttcttctatctaatttatcttttgttttgcatatgtatattttttttcttccttgttcttgactactaattaattaattaattgcaaaactaaacattgtctttggtttgtattaatttgtatattacttggccgtacgttatcatgtgatcaacatatatgcattgcagaaaccatcaaatgaaagaatatgtggtgaatggcagctaaaaaaatgatctagggtttcgtgataatatgaagtgtatagtgtgtgtctctaaatgaaaatttgtattacttcgatctctcagctgtgaataattgcgtgggtctatacatctcaactaccaattaggaggtgtgttagatggatgcttatttcttggtcaaaaaataacacataaaaatcacatgattcacatatatgatgtgtaatcttaattaacagattaaattttgttacttaccgttatatatatgcaaatatgcagcatcaagccaccatgg

SEQ ID NO: 96 - DNA, 761 bp, Oryza sativa
  misc_feature (1)..(761): AY177696 3'-regulatory sequence engineered
  misc_feature (1)..(265): 3'-untranslated sequence
  misc_feature (266)..(761): 3'-nontranscribed sequence
cccagaaaaacattgttttgctacacccttgtatgctgaagggatactatttgctgtcaagagttgatactcagatcaagaaaaaaaaaactattcatgccatagtgattgagaaatggacttgtatactggaaataaatgccacagtggaattgagttgtggaatccaggcaatgagtgttttatgattcaatttttccatgtatttttcatatattaaccagtgcgggcttgtgtaaaaaatataaccaggcaaggaaaattagctgtattgtgcatatggagcaaatttcaggcgttactaccattaaaatcatgacatgctgtaagcaaatatcttgtagacctttatctacatagatttttttcagtaggggcctccctaccgtttcaaaagaaaaagaatgcagatgattgatatttcgaatgccttcagacatggataattcataactattgcgatgtggaaccttcttaattttcaatttttaacacgctatctacaagtggaatatcataatcatttgcttgtcttcattagtaagacaagtttgaatgcacgtgccaatgtgagacaaccgtaccatataacggccattagtgctagattggctttgcaccatgaaaacattggttttacaacctactgtgaggacattaaaagcagagatactctagctggcctgtttggagataaacagtcgagaaatattgtgaagacaatcaaagtgtttattcctgggatgcagtccaatcccaaa

SEQ ID NO: 97 - DNA, 2040 bp, Oryza sativa
  misc_feature (1)..(2040): AY177698 5'-regulatory sequence
  misc_feature (1)..(1466): 5'-nontranscribed sequence
  misc_feature (1467)..(1654): Exon
  misc_feature (1655)..(2023): Intron
  misc_feature (2024)..(2040): Exon
aagatttgaactactgccttgtcttccatgtttcatagagtcatgaacctatttaaatgttgaatttgggaagagtatgtcaaaatggactgcctgaagtggtaacctgtaactactgcaacattcaggcaagtggcacacaatttgttttgacaaagaatttgtatgcataaaacactaacacagcacataactactatattccttactaggtgtgaacatggctgaagtctcttagaaaaacaaaaacagataatgacacaccaggcaaatatgtatgagccttggcctcctatgcctcaactgcctcctgataaggagagcataatctccttaccatataagtcactatgatggttcccgaactccattggaagtactccatttaagagaagttctgttttcaccttgttctgctggctcctcatcatgacttatgaatataaattcacaagtgtccttctgatttttttttttttgaaacttaagaaacaccttgagactttttttttcttgtgaattgcaatgaatgagcaccaaaaatctgaaaaaaacctatccagagaaaactctgattgttcatcacttattattttctttgagaccagaactggtaagctctgggacttacattggtacaaagtgaagatatgtacatgtggcatagtatgtcatatatattgactatgacatccagcaggttaggtgtgtagggtggaccagaagctgccttactgaaaacattattgcttctagttattctctgtcttggtcaattctagcttggccttcttataggagaaacctggctgcaagcctgcaagctcatcacttgctatgctcaggggcagttacctgtccacagcaaggctgtttcaagcctccagcattatcttctccagttttttggtgccatctcaaaatacacacaaacccacacataaactccatcagcatgtatataagtgctaatttaaggacatactgttgtatgcactagttcacatgatagatatctggaacgtataaggtagtttaaagtctgtgtgcaaatacattttgttaaattgcataagttttataggaagttaatttagctaaatggctttatttgcgagttcgatcatattatggtgtgttatgttccttgctgcaatatatagtgggacaacctgacaagagatcatcactggtactggtcttttaagactgacataagaatttagcaggcatataaaggtgccctgagcccctgaaaactctctctctctctctctctctctctctctctctctcgtttcctgaatctgaggccatttgtttggtacatttctcatcatgcatttgaaatcatttctttgattttggtcttgcttgagcttttgtttcatgatccatgactagtacattttgaagaacactttctttgcaggctgaacaggaggaaagaagcaccaacctgatcaatggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggtatgcataaagttttttgtttcaagtattgtctgtcctttgcatttggttttgttttgaggcgaaatagaaatttcagacatcgttcataatacttcttgttaaatttcttcggtttcttcgatcagttctgctctattctacaacttttctatgatttttggaacttgtgttggaaaaaattgttgataatatgcaatgtttcatcatcatattttgaactgaattattagtgatgaactcaagggaatttacaactgattttatacaagtttctgccacctacagccatttcaacttagcttaaccatgtgaaattctcgaagagaaaccgatgatcaaatacataaagtcttttccttttggcaggattgcaaatatctttg

SEQ ID NO: 98 - DNA, 1029 bp, Oryza sativa
  misc_feature (1)..(2040): AY177698 3'-regulatory sequence
  misc_feature (1)..(27): 3'-untranslated sequence
  misc_feature (28)..(2040): 3'-nontranscribed sequence
tgattgccctctttccatcccaataggagatgcaaattccaggagatcagagcaactatctgtgccacatggtaagccatgctctaagctttctcctcaagtgaaattatgttgcggatttctgtattcgcgtaacttgtttgcgcctgtcaaaagaacctgattggcgagcaggctcaggcacctctgatggtgaatccagaagccgttcccgctgtgggatgtgggtggcagcagccagatgtacaatcaggatgctgagtcattccatgacagcgctgcagctttcacctcagcttgagtacaagcttaagccgctgcagcccaacctgcaggaggaggccaacctccatggctacgttcttcggctgtggtaagtcgctctctgcctcgtctttggctgctcgtttgatccatggacaagatcatcagtagtttgaagtgccataactttgcggttgtcatcatatgacagaattaaaatcctgtaaactcatcatgtgctgtaaattgtggttacctggaacttttttttttttgccgggtcgacaaagaagccgaccgaagtatattaagtattacctggaacattttgatcagtcatgaaacagaatgatctccaagaaactttatacattgacaaattgagttgttatctgcagattcctaaggacaccatggagtctggatgcaactgagcaaccaattgaggataatgagcttgtctgcctgaatctgctccagaactctagtctaaccagctgagaaataaactatatatacgcttcctgtgttattgaactgtttggctatgttgcatgtaaagtaatgataagtatggctttcttgtgtgttttcaagaactaatggctactattaaggtgtgtaacggttatgtacaacatatatgatgaccgtacatggtgagaatgcgtcttatttgagattgagccatattatgccggggatttccttatagcaaataaatcagtaaatcataaatctgaacaatatttcttttaggttaac

SEQ ID NO: 99 - DNA, 2041 bp, Oryza sativa
  misc_feature (1)..(2041): AY177698 5'-regulatory sequence engineered
aagatttgaactactgccttgtcttccatgtttcatagagtcatgaacctatttaaatgttgaatttgggaagagtatgtcaaaatggactgcctgaagtggtaacctgtaactactgcaacattcaggcaagtggcacacaatttgttttgacaaagaatttgtatgcataaaacactaacacagcacataactactatattccttactaggtgtgaacatggctgaagtctcttagaaaaacaaaaacagataatgacacaccaggcaaatatgtatgagccttggcctcctatgcctcaactgcctcctgataaggagagcataatctccttaccatataagtcactatgatggttcccgaactccattggaagtactccatttaagagaagttctgttttcaccttgttctgctggctcctcatcatgacttatgaatataaattcacaagtgtccttctgatttttttttttttgaaacttaagaaacaccttgagactttttttttcttgtgaattgcaatgaatgagcaccaaaaatctgaaaaaaacctatccagagaaaactctgattgttcatcacttattattttctttgagaccagaactggtaagctctgggacttacattggtacaaagtgaagatatgtacatgtggcatagtatgtcatatatattgactatgacatccagcaggttaggtgtgtagggtggaccagaagctgccttactgaaaacattattgcttctagttattctctgtcttggtcaattctagcttggccttcttataggagaaacctggctgcaagcctgcaagctcatcacttgctatgctcaggggcagttacctgtccacagcaaggctgtttcaagcctccagcattatcttctccagttttttggtgccatctcaaaatacacacaaacccacacataaactccatcagcatgtatataagtgctaatttaaggacatactgttgtatgcactagttcacatgatagatatctggaacgtataaggtagtttaaagtctgtgtgcaaatacattttgttaaattgcataagttttataggaagttaatttagctaaatggctttatttgcgagttcgatcatattatggtgtgttatgttccttgctgcaatatatagtgggacaacctgacaagagatcatcactggtactggtcttttaagactgacataagaatttagcaggcatataaaggtgccctgagcccctgaaaactctctctctctctctctctctctctctctctctctcgtttcctgaatctgaggccatttgtttggtacatttctcatcatgcatttgaaatcatttctttgattttggtcttgcttgagcttttgtttcatgatccatgactagtacattttgaagaacactttctttgcaggctgaacaggaggaaagaagcaccaacctgatcaaaggggcgtgggagagtagagctcaaaaagattgaaaatccgacaaaccgccaagttaccttctccaagaggaggatcgggctgctcaagaaagcaaatgagctggccattctttgtgatgcacaaattggggtgattgtgttctcaggcactggcaagaagtacgagtactccagccccccttggaggtatgcataaagttttttgtttcaagtattgtctgtcctttgcatttggttttgttttgaggcgaaatagaaatttcagacatcgttcataatacttcttgttaaatttcttcggtttcttcgatcagttctgctctattctacaacttttctatgatttttggaacttgtgttggaaaaaattgttgataatatgcaatgtttcatcatcatattttgaactgaattattagtgatgaactcaagggaatttacaactgattttatacaagtttctgccacctacagccatttcaacttagcttaaccatgtgaaattctcgaagagaaaccgatgatcaaatacataaagtcttttccttttggcaggattgcaaaccaccatgg

SEQ ID NO: 100 - DNA, 1025 bp, Oryza sativa
  misc_feature (1)..(1025): AY177698 3'-regulatory sequence engineered
  misc_feature (25)..(1025): 3'-nontranscribed sequence
ttgccctctttccatcccaataggagatgcaaattccaggagatcagagcaactatctgtgccacatggtaagccatgctctaagctttctcctcaagtgaaattatgttgcggatttctgtattcgcgtaacttgtttgcgcctgtcaaaagaacctgattggcgagcaggctcaggcacctctgatggtgaatccagaagccgttcccgctgtgggatgtgggtggcagcagccagatgtacaatcaggatgctgagtcattccatgacagcgctgcagctttcacctcagcttgagtacaagcttaagccgctgcagcccaacctgcaggaggaggccaacctgcatggctacgttcttcggctgtggtaagtcgctctctgcctcgtctttggctgctcgtttgatccaaggacaagatcatcagtagtttgaagtgccataactttgcggttgtcatcatatgacagaattaaaatcctgtaaactcatcatgtgctgtaaattgtggttacctggaacttttttttttttgccgggtcgacaaagaagccgaccgaagtatattaagtattacctggaacattttgatcagtcatgaaacagaatgatctccaagaaactttatacattgacaaattgagttgttatctgcagattcctaaggacacgatggagtctggatgcaactgagcaaccaattgaggataatgagcttgtctgcctgaatctgctccagaactctagtctaaccagctgagaaataaactatatatacgcttcctgtgttattgaactgtttggctatgttgcatgtaaagtaatgataagtatggctttcttgtgtgttttcaagaactaatggctactattaaggtgtgtaacggttatgtacaacatatatgatgaccgtacatggtgagaatgcgtcttatttgagattgagccatattatgccggggatttccttatagcaaataaatcagtaaatcataaatctgaacaatatttcttttaggttaa

SEQ ID NO: 101 - DNA, 2012 bp, Oryza sativa
  misc_feature (1)..(2012): AY177699 5'-regulatory sequence
  misc_feature (1)..(1566): 5'-nontranscribed sequence
  misc_feature (1567)..(1881): Exon
  misc_feature (1882)..(1998): Intron
  misc_feature (1999)..(2012): Exon
tccggtcggccctcgtcctccccgtcctctcggcgccggcggtagagaagagagaaaggcggggagatcagcggtggagaagagagaaaggtggggagtgaagagataaaggtgggaaattttgttagagtggtgatacatatgtggtagttgtaaaaattagtaaaatatagtatgtaatatggatgatctgttggagtgaaaagtaatatagagtaggaatctttttggatgactatctaaataagagtatagaagatggaatttagatgagctgttgaggatgctcttatcaattttgcacccaggtgtgctcaattattcaccccctcagacctaccgaaacggagtatagcaaatagtatacgactatacttaatactgagtgtgcttaggaactgaaaaacgtatttatgttctatgtgaaaatgtaacggtctacacgtacagtggcatagctctgtttagttaccaaaataaaaattttcacgttgtcacatcgaatgtttggacacatgcatatagtattaaatttagaaaaaaaaaccaattacatagattgcgtgtaaaattgcaagatgaattttttacgcttacttgcgccatgatttgaaaatgtggtactacagtaaatatttgttaatgatggattaattaggcttaataaattcatctcgcagttttctggcgaaatccgtaatctggcgaaatccgtaatttattttattattagactaaatttaatattttaaatgtgtgtccgtatgtttgatgtgacaaacaaacttaaaattttcctcaattaaaacttttggatgtcacatcagacgtttgatcggatgttgaaaggggttttcggacacgaataaaaaaagtaatttcataactcgcctggaaaccgcgagacgaatcttttgagcctaattaagctgtcattagcacatatgggttactgtagcacttatggctaatcatggactaattatgctcaaaagattcgtctcacgatttacatgcaaaccgtgcatttagtttttttttatctatttttaatgcttcatacatgtatccaaaaattcgatgtgatgtttttgtgaaaagtttttgaaaactaaacggtgcctaaacaaggccatactgggatggctcttcagcgcgcttgaggggctttgagccgatagatagtttcgaaaccaacaaaatgcagtagaagtactctcgagctatagtcgcgacgtgctgccccgcaggagtacagtagtagtacaacgtaagcgggagcaacagactccccccctgcaacccactgtgcctgtgccctcgacgcgtctccgtcgctttggcaaatgtcacgtacatattaccgtctcaggctctcagccatgctccctaccacccctgcagcgaagcaaaagccacgcacgcggcgcctgacatgtaacaggactagaccatcttgttcatttcccgcaccccctcctctcctcttcctccatctgcctctttaaaacagtaaaaataaccgtgcatcccctgggcaaaatctctcccatacatacactacagcggcgaacctttccttattctcgcaacgcctcggtaacgggcagcgcctgctccgcgccgcggttgcgagttcgggaaggcggccggagtcgcggggaggagagggaggattcgatcggccagaatggggagggggcgcagcgagataaagaggatagagaaccccacgcagcggcagtccaccttctacaagcgcagggacggcctgttcaagaaggccagggagctcgccgtcctctgcgacgccgacctcctcctcctcctcttctccgcctccggcaagctctaccacttcctctcccccaccgtcccctcgtaagctgccctgccacacatccgcttgtcgatccgtcacgtatgtatatgcgcgcgcgctgtctcctgacattgttggttaatccacgtttcgttgctgcttctttcttggcgcagcgtgagggagtttg

SEQ ID NO: 102 - DNA, 728 bp, Oryza sativa
  misc_feature (1)..(728): AY177699 3'-regulatory sequence
  misc_feature (1)..(212): 3'-untranslated sequence
  misc_feature (213)..(728): 3'-nontranscribed sequence
tagaaacagatggacgcttgacgttcagatttcctttattgctgcttagagccagtgttctattatgaaagattatgctgaacttttccggggttaagcaatatctagaagtgtttgcggcaagagctcatcttttgtttcctgatctcatgggaactctctgcacggcgtcatgtattaggcgaatattagcatcacatcggaaactactgaatattaccttcgtcaatcttgttttcactttagacaaaaagaaaaggaaaaagaacaaaaaaaatccagaccgaaggaaaatcagtgagagatctcagcagaaaattgctcgtctccacagactcaaagaagcaacgacaaacaaaacgataacagcaacgaggagctcagcaagaacgtagcgatatagagattataaatcacatcacagagatcatactcaaatctcatcattgctccaaatcgttgcaaatcaatctgaaaaaacggcaagagaggtaaaatcacgctaagcaatagagccatcccaaagcaaaaggaggaaacaaaaaaaacgccacaacgacgggagagaatggggaggctgcgcaatgcccttccggattcactagtcgcccccgggcttttaagagccgcaatcctacaaacggcggggcgaaaaccctaggccgctgaatcgatgaccgtctgatcaaccgttgatggacaagatttcgtatccttgcaccaagcct

SEQ ID NO: 103 - DNA, 2013 bp, Oryza sativa
  misc_feature (1)..(2013): AY177699 5'-regulatory sequence engineered
tccggtcggccctcgtcctccccgtcctctcggcgccggcggtagagaagagagaaaggcggggagatcagcggtggagaagagagaaaggtggggagtgaagagataaaggtgggaaattttgttagagtggtgatacatatgtggtagttgtaaaaattagtaaaatatagtatgtaatatggatgatctgttggagtgaaaagtaatatagagtaggaatctttttggatgactatctaaataagagtatagaagatggaatttagatgagctgttgaggatgctcttatcaattttgcacccaggtgtgctcaattattcaccccctcagacctaccgaaacggagtatagcaaatagtatacgactatacttaatactgagtgtgcttaggaactgaaaaacgtatttatgttctatgtgaaaatgtaacggtctacacgtacagtggcatagctctgtttagttaccaaaataaaaattttcacgttgtcacatcgaatgtttggacacatgcatatagtattaaatttagaaaaaaaaaccaattacatagattgcgtgtaaaattgcaagatgaattttttacgcttacttgcgccatgatttgaaaatgtggtactacagtaaatatttgttaatgatggattaattaggcttaataaattcatctcgcagttttctggcgaaatccgtaatctggcgaaatccgtaatttattttattattagactaaatttaatattttaaatgtgtgtccgtatgtttgatgtgacaaacaaacttaaaattttcctcaattaaaacttttggatgtcacatcagacgtttgatcggatgttgaaaggggttttcggacacgaataaaaaaagtaatttcataactcgcctggaaaccgcgagacgaatcttttgagcctaattaagctgtcattagcacatatgggttactgtagcacttatggctaatcatggactaattatgctcaaaagattcgtctcacgatttacatgcaaaccgtgcatttagtttttttttatctatttttaatgcttcatacatgtatccaaaaattcgatgtgatgtttttgtgaaaagtttttgaaaactaaacggtgcctaaacaaggccatactgggatggctcttcagcgcgcttgaggggctttgagccgatagatagtttcgaaaccaacaaaatgcagtagaagtactctcgagctatagtcgcgacgtgctgccccgcaggagtacagtagtagtacaacgtaagcgggagcaacagactccccccctgcaacccactgtgcctgtgccctcgacgcgtctccgtcgctttggcaaatgtcacgtacatattaccgtctcaggctctcagccatgctccctaccacccctgcagcgaagcaaaagccacgcacgcggcgcctgacatgtaacaggactagaccatcttgttcatttcccgcaccccctcctctcctcttcctccatctgcctctttaaaacagtaaaaataaccgtgcatcccctgggcaaaatctctcccatacatacactacagcggcgaacctttccttattctcgcaacgcctcggtaacgggcagcgcctgctccgcgccgcggttgcgagttcgggaaggcggccggagtcgcggggaggagagggaggattcgatcggccagaatcgggagggggcgcagcgagataaagaggatagagaaccccacgcagcggcagtccaccttctacaagcgcagggacggcctgttcaagaaggccagggagctcgccgtcctctgcgacgccgacctcctcctcctcctcttctccgcctccggcaagctctaccacttcctctcccccaccgtcccctcgtaagctgccctgccacacatccgcttgtcgatccgtcacgtatgtatatgcgcgcgcgctgtctcctgacattgttggttaatccacgtttcgttgctgcttctttcttggcgcagcgtgagccaccatgg

SEQ ID NO: 104 - DNA, 725 bp, Oryza sativa
  misc_feature (1)..(725): AY177699 3'-regulatory sequence engineered
  misc_feature (1)..(209): 3'-untranslated sequence
  misc_feature (210)..(725): 3'-nontranscribed sequence
aaacagatggacgcttgacgttcagatttcctttattgctgcttagagccagtgttctattatgaaagattatgctgaacttttccggggttaagcaatatctagaagtgtttgcggcaagagctcatcttttgtttcctgatctcatgggaactctctgcacggcgtcatgtattaggcgaatattagcatcacatcggaaactactgaatattaccttcgtcaatcttgttttcactttagacaaaaagaaaaggaaaaagaacaaaaaaaatccagaccgaaggaaaatcagtgagagatctcagcagaaaattgctcgtctccacagactcaaagaagcaacgacaaacaaaacgataacagcaacgaggagctcagcaagaacgtagcgatatagagattataaatcacatcacagagatcatactcaaatctcatcattgctccaaatcgttgcaaatcaatctgaaaaaacggcaagagaggtaaaatcacgctaagcaatagagccatcccaaagcaaaaggaggaaacaaaaaaaacgccacaacgacgggagagaatggggaggctgcgcaatgcccttccggattcactagtcgcccccggccttttaagagccgcaatcctacaaacggcggggcgaaaaccctaggccgctgaatcgatgaccgtctgatcaaccgttgatggacaagatttcgtatccttgcaccaagcct

SEQ ID NO: 105 - DNA, 1334 bp, Oryza sativa
  misc_feature (1)..(1334): AY177700 5'-regulatory sequence
  misc_feature (1)..(1049): 5'-nontranscribed sequence
  misc_feature (1050)..(1231): Exon
  misc_feature (1232)..(1318): Intron
  misc_feature (1319)..(1334): Exon
ataagtatttcagaaagctgaagttgaatgttggctcaaattacacccctccaaacttgaaaagaattattcatttacatgatgctagacgagtggccaacatctaggcatttacttacatgcttactggcaacaagtttcagccatgagtactttagagtaaaaaaacagtgccgatgctggtttggctgaatctggatgaaaactgaaaaccaaatgaacaaatatattatttaaggcatactgatgcaagggtggcatacaaacatgttttcaattttgcctttcgatcatacaagaatgcttactaacattaatccatgtcaatgctgcagtggaatatacattatcacaaataaatatacatgattttactgaattttcagcaatattcattaataaacgtacatatcaatcaattttacagtaatacgatattttttctagatccaatgtaacaaacattcaccgcatcttctgccatatgtgatctgatacttgaaacctaaacttttactgatactaacaaacttgctagatagattctccatagagacgtacaggaacttgattccataaacaaggtaaaagagtaagtcatacaacagaactggagaataaatgtatggccagctctatatgctcaagataagccaactttaagggaaagaacaatggagaagtcattagatgtgacataagatcttagaggaacagctaaattaatcataacaaacgaacagcaattatacaagtatatcatatagagatatgacaatatttataagaatctacatgagcaggaagaaagatgtacagtgacctgcaagatgcttttcagtggcttacaacaaagcaatcagtgctatccaaaggtcatactcatattcccttgaaggtggactggtatataaaagcaggccatccacctgcatgtgtacttcgatttgagaggaacacaaggtcaatatctccttgttactagtgccacagctgtagcttcaagtctagtccaggccaaaggttatctgcaggaagagtgaaacaacatggtcagaggaaaggtgcaaatgcgacgaatagagaaccctgtccacagacaggtaaccttctgtaagcgccgtggggggctcctcaagaaggccagggaactatcagtgctttgtgatgctgatgtaggtgttatcatattctcctctcagggaaaactccatgaattagctactaatgggtgtgtttccaaattcatgttttatatagaatttgtaatttgtgaatacaattctgaaatgctttccttttgttcacaaaatgcaagaaatatgcataacttg

SEQ ID NO: 106 - DNA, 1088 bp, Oryza sativa
  misc_feature (1)..(1088): AY177700 3'-regulatory sequence
  misc_feature (1)..(17): 3'-untranslated sequence
  misc_feature (18)..(1088): 3'-nontranscribed sequence
tagccgtcaaaggaccttggtcaattcaactccgggtatatctacaaggcatgcttatcattcaaagagtacatgttatactaagcccatacgaaccgaactgtattttgttgttgtggaccttccgtcttaattaaagtgtgttcaacagatctatatttgtaatgtaagcgtatcgagaagctccatttgttccataatattgtgaaacagcatagtgacaatagactattgtggatttcagttgcaatgcaaaattcagacatgtttcacagattatcacaatcctatgttccgcatcggggaggggaagggggggggggtttacttggccactcacatcacagtcacaggagagcgatgaggacgaagaggaggagcgcggcgacgaaggagtacttgacggcggcggtgaatatggcgaacgagatgagcgccagctgcagcagcagcgacgcgccggcccaggcgagcgcggccgacagcgccaccgccgccgcgttcgctggctccggggtcagcagctccccccaccggatctccgacagcgccgggagcgacgggcccttccgccgcttctcctccccctcctccgccgggggcccaccatcgccatcgccgccgcctccgccgttcgccgccagggcgacggcgaggcggcggcggtggcgggggcggagggtggagggggacgtcggcatcagggagatggggtgggggagtggaggacgacggcgtagggggaggaggaagagtggagctagggttccggccaccgccgccattggagcggtggaggtggagctcgagttgagtggaggagggaaatgagtgggggaatcgggttggcaattgacgccgtgcggtgcgagcacgtggcgttcatccgattggcaatggacggttcagattaactcatcggtgcggtgcaaccgacgtcacaagggtttcaaacacgtcatcataggattcataaccatggacatgttcggttgtactccctccgtctcatagaaaggtaaaccctagaatcatagaaaggtaaactctagaatctcaaagtcaaagtaaaagtactagtaaaatta

SEQ ID NO: 107 - DNA, 1335 bp, Oryza sativa
  misc_feature (1)..(1335): AY177700 5'-regulatory sequence engineered
ataagtatttcagaaagctgaagttgaatgttggctcaaattacacccctccaaacttgaaaagaattattcatttacatgatgctagacgagtggccaacatctaggcatttacttacatgcttactggcaacaagtttcagccatgagtactttagagtaaaaaaacagtgccgatgctggtttggctgaatctggatgaaaactgaaaaccaaatgaacaaatatattatttaaggcatactgatgcaagggtggcatacaaacatgttttcaattttgcctttcgatcatacaagaatgcttactaacattaatccatgtcaatgctgcagtggaatatacattatcacaaataaatatacatgattttactgaattttcagcaatattcattaataaacgtacatatcaatcaattttacagtaatacgatattttttctagatccaatgtaacaaacattcaccgcatcttctgccatatgtgatctgatacttgaaacctaaacttttactgatactaacaaacttgctagatagattctccatagagacgtacaggaacttgattccataaacaaggtaaaagagtaagtcatacaacagaactggagaataaatgtatggccagctctatatgctcaagataagccaactttaagggaaagaacaatggagaagtcattagatgtgacataagatcttagaggaacagctaaattaatcataacaaacgaacagcaattatacaagtatatcatatagagatatgacaatatttataagaatctacatgagcaggaagaaagatgtacagtgacctgcaagatgcttttcagtggcttacaacaaagcaatcagtgctatccaaaggtcatactcatattcccttgaaggtggactggtatataaaagcaggccatccacctgcatgtgtacttcgatttgagaggaacacaaggtcaatatctccttgttactagtgccacagctgtagcttcaagtctagtccaggccaaaggttatctgcaggaagagtgaaacaacaaggtcagaggaaaggtgcaaatccgacgaatagagaaccctgtccacagacaggtaaccttctgtaagcgccgtggggggctcctcaagaaggccagggaactatcagtgctttgtgatgctgatgtaggtgttatcatattctcctctcagggaaaactccatgaattagctactaaagggtgtgtttccaaattcatgttttatatagaatttgtaatttgtgaatacaattctgaaatgctttccttttgttcacaaaatgcaagaaatttgcccaccatgg

SEQ ID NO: 108 - DNA, 1084 bp, Oryza sativa
  misc_feature (1)..(1084): AY177700 3'-regulatory sequence engineered
  misc_feature (1)..(13): 3'-untranslated sequence
  misc_feature (14)..(1084): 3'-nontranscribed sequence
cgtcaaaggaccttggtcaattcaactccgggtatatctacaaggcatgcttatcattcaaagagtacatgttatactaagcccatacgaaccgaactgtattttgttgttgtggaccttccgtcttaattaaagtgtgttcaacagatctatatttgtaatgtaagcgtatcgagaagctccatttgttccataatattgtgaaacagcatagtgacaatagactattgtggatttcagttgcaatgcaaaattcagacatgtttcacagattatcacaatcctatgttccgcatcggggaggggaagggggggggggtttacttggccactcacatcacagtcacaggagagcgatgaggacgaagaggaggagcgcggcgacgaaggagtacttgacggcggcggtgaatatggcgaacgagatgagcgccagctgcagcagcagcgacgcgccggcccaggcgagcgcggccgacagcgccaccgccgccgcgttcgctggctccggggtcagcagctccccccaccggatctccgacagcgccgggagcgacgggcccttccgccgcttctcctccccctcctccgccgggggcccaccatcgccatcgccgccgcctccgccgttcgccgccagggcgacggcgaggcggcggcggtggcgggggcggagggtggagggggacgtcggcatcagggagatggggtgggggagtggaggacgacggcgtagggggaggaggaagagtggagctagggttccggccaccgccgccattggagcggtggaggtggagctcgagttgagtggaggagggaaatgagtgggggaatcgggttggcaattgacgccgtgcggtgcgagcacgtggcgttcatccgattggcaatggacggttcagattaactcatcggtgcggtgcaaccgacgtcacaagggtttcaaacacgtcatcataggattcataacgatggacatgttcggttgtactccctccgtctcatagaaaggtaaaccctagaatcatagaaaggtaaactctagaatctcaaagtcaaagtaaaagtactagtaaaatta

SEQ ID NO: 109 - DNA, 3338 bp, Oryza sativa
  misc_feature (1)..(3338): AY177702 5'-regulatory sequence
  misc_feature (1)..(1981): 5'-nontranscribed sequence
  misc_feature (1982)..(2163): Exon
  misc_feature (2164)..(3325): Intron
  misc_feature (3326)..(3338): Exon
tcttttcgcaaactaaacaaggccttaacatgctagaaatttagaaaattccacattaattgactataatccatcctaaattttcatccatggcatctaggaagagatcaataatgatgttgacaaccaaattcggcaccagattgattctattcataaattgcagaattaagagccattttcgtagaaggctgtggttaattagaccgcagtgcatatgccggtttgatcaggaccatggcagtctgatggccaatctgattggcgtggagcatgcggcctaaccggcaaactccgagtccgatagagtctcatgttcttctgcttgtttgagatttttttagtcctaatacattccaggacctacttacactacgagaattcagaatttgcttggtggccatctaatctctttggcggttcgacatcacctaaggtaaagtgtattcttatcggtctagactgccaaggttatatttcttgactattcgaaagtttaatattctccgtagttttcttggcggttagaccgccaataaaattttctctcacggttagcagccaagaaacctggattttcctgtcactctagacttggcggttggatgtcaaaatatattatcttagtggttttcatgctatccttggtggtttttggccgcgaagaaaattccgaattcttgtagtgttgggacgtggataggctttgtttatgtaagatcaacccctttataagagctataactaattcatcgagacaaccagcacacaatcaatcaaagaatcgttcttataccctttttctttacttctacccctttaaccctagttcatccatcttcatcaatttgcattgaaagccatccactttttgcggcgagagtacgaaatcttttataggtttgtcccaaaaatcttccgttccgtccatgatatggttgtttatccccaaattaatctaaattggttctgctagcctattttgattctatcaccgccaagatcagaagccacaccatctactttgggcaatggttcaagatcaagaggcaccactacttcatctacatcaacaataccggaggctcgatcggtttgtgtgtcgtcaaatagtcttttgtaacacgtatatggctccagcatggattcatgtccagctaattattgcaagcaaaatgagatgtgttgagtcctttcctatcacttacatgacactatacatattaatttttagcttatatgcaattctatagccagtattatgaatggggagtggtacctattttgagcaaacgatgaggtgtacaatatcgtactggaaaatgtaaaatgtacttatcatgagctgtagccgcactcataaccaatcaataactggcacaaggaaagccatggaacatctttacatggtctttcttgcggcatggttttaaagtagcaaattcgtgctaccgtatatgaacatgtgaccgtgacacaaaatcaagaaatccagaatgaacatggatcctaagcacatgacctcaccgatcgatcaccaccaaagcctttttccatttgtgtggcaataataattaaagttttgtatagtttagtacatggcgccggcgggtaattaagctgcagccacctgcatccgatccattcgtgcatataacctaaccacccatttcgccttctctccactctctctcctctccctctctctctctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaagtaagcaatccatcggatttataagtatatatgtatatttcccctaatttaattgtagtttccttagttgttctcggatctgctttgaagtctccttttgttcttgatttatttttgaaagaactctccttgttctttcacttgataggtatatatatctggttctggtaatctttcatccttttaagtttgagacgtttttatcaacaaaatgacccaagtatatgtctgatcagcttttcatcctttcaagttttgaggcatttttatcaacacaaagacccaagctaagcatatatgtatgcatggctattagtcattcttgtgatcttttagtaagctatagctacatagcaatcaatatgtatgcatatagtgtcagtttaattgtgatattttccctccgttctcgaaaacaattgacacttggcactactaagttttgatcactccttttctttcaaaaaatttataaacacttaaaatatgttatattattaaagtatgtagcgtagaaaatataaccatacaacttccattcatcatcatataattatttaaaagtaatttgtgatcaaagtaacagccgtagtactcaaccgtgtcaaccaagtcagttattcaagaactgagggagtaaatattgaatgcaaaattaatatgaaaattttttcttctgctatatatcctttttcagcgtacgtatgttcactcttctgaattgattacaacttagaaactcaaggtggatatatagcgaagaaatattaacatgttaacgtttaataaaattagatgaatttgttctctttttttttgtttcaagtgatgttgatttgtaccaaaatcagatggcatgtgtcacggtcaaacttattaattaaagagatttagcatgcaatcttgacaatcaaatctttacagagaatggcatttctatatatgaagccttacatgcatgtgcataaatatttttttggagctagagtgtggtagctttacgtgccactgcatcaaagacagatagatatttccagatttttaaatatctatttatctgtgtgttttgtctaagtaaattgaaggttttttaatataagctgtatgttttagctaaaaatgaaacaactgactcaaccatttggctttacttgcatgctagcatgaaaactgtg

SEQ ID NO: 110 - DNA, 886 bp, Oryza sativa
  misc_feature (1)..(886): AY177702 3'-regulatory sequence
  misc_feature (1)..(285): 3'-untranslated sequence
  misc_feature (286)..(886): 3'-nontranscribed sequence
taagactatgccgtacaagctggacgataagtgatcaatttcaaacaagcacaaagcctttcagatgcaagtagtatttttgtgatagctgagacaataaaaaagtgtacagactacagactggacagattatgttgtcggatgctcatgtaatgactgtggtgtaataagaaatacgtagtataagtttgtaaccctgcttactctctattgctttctagaaaagctcaaccaaaactctgaaaagtctttggactgaaaaggttgtaacaatgtttaccaggaaggtgctttggtgatgaaaaaagagttgtcactatgcctaagaaggaaggggtgtgagctactggcgaaaactgttatgtattgcacatggtgaataatggctgttgaacatgtctactcagacttaacagtcagcccttactcatggctgttcaagtggtgttacagatgaaggtgcatccaacccaattcaaagcagcaacactcatactggtgctgcaaataccgtgtatgctagagagaggtggttggatagaaggcccatgtatcatgtcatgtcattgattcacaatttcacgtgtcgcaacatttattattagtagtattctactgcaagtctgcaactaagaaataaatcttctgttaaacatgaacggctcctgatgcaatacactggagttaaccactaaaatctcagcaattgaaagttccacttagaaaagcccataccacattaaaatggtaatgcctgtatttaattgattttgaattaaaagtggtgctatcaactttgagttccaaaactaattatttccaaagaaaaaggtaattcaataattaccatcacttggtatagattggtcttctgtgacaaccacgg

SEQ ID NO: 111 - DNA, 3339 bp, Oryza sativa
  misc_feature (1)..(3339): AY177702 5'-regulatory sequence engineered
tcttttcgcaaactaaacaaggccttaacatgctagaaatttagaaaattccacattaattgactataatccatcctaaattttcatcgatggcatctaggaagagatcaataatgatgttgacaaccaaattcggcaccagattgattctattcataaattgcagaattaagagccattttcgtagaaggctgtggttaattagaccgcagtgcatatgccggtttgatcaggaccatgccagtctgatggccaatctgattggcgtggagcatgcggcctaaccggcaaactccgagtccgatagagtctcatgttcttctgcttgtttgagatttttttagtcctaatacattccaggacctacttacactacgagaattcagaatttgcttggtggccatctaatctctttggcggttcgacatcacctaaggtaaagtgtattcttatcggtctagactgccaaggttatatttcttgactattcgaaagtttaatattctccgtagttttcttggcggttagaccgccaataaaattttctctcacggttagcagccaagaaacctggattttcctgtcactctagacttggcggttggatgtcaaaatatattatcttagtggttttcatgctatccttggtggtttttggccgcgaagaaaattccgaattcttgtagtgttgggacgtggataggctttgtttatgtaagatcaacccctttataagagctataactaattcatcgagacaaccagcacacaatcaatcaaagaatcgttcttataccctttttctttacttctacccctttaaccctagttcatccatcttcatcaatttgcattgaaagccatccactttttgcggcgagagtacgaaatcttttataggtttgtcccaaaaatcttccgttccgtccatgatatggttgtttatccccaaattaatctaaattggttctgctagcctattttgattctatcaccgccaagatcagaagccacaccatctactttgggcaatggttcaagatcaagaggcaccactacttcatctacatcaacaataccggaggctcgatcggtttgtgtgtcgtcaaatagtcttttgtaacacgtatatggctccagcatggattcatgtccagctaattattgcaagcaaaatgagatgtgttgagtcctttcctatcacttacatgacactatacatattaatttttagcttatatgcaattctatagccagtattatgaatggggagtggtacctattttgagcaaacgatgaggtgtacaatatcgtactggaaaatgtaaaatgtacttatcatgagctgtagccgcactcataaccaatcaataactggcacaaggaaagccttggaacatctttacatggtctttcttgcggcatggttttaaagtagcaaattcgtgctaccgtatatgaacatgtgaccgtgacacaaaatcaagaaatccagaatgaacatggatcctaagcacatgacctcaccgatcgatcaccaccaaagcctttttccatttgtgtggcaataataattaaagttttgtatagtttagtacatggcgccggcgggtaattaagctgcagccacctgcatccgatccattcgtgcatataacctaaccacccatttcgccttctctccactctctctcctctccctctctctctctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatcgggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaagtaagcaatccatcggatttataagtatatatgtatatttcccctaatttaattgtagtttccttagttgttctcggatctgctttgaagtctccttttgttcttgatttatttttgaaagaactctccttgttctttcacttgataggtatatatatctggttctggtaatctttcatccttttaagtttgagacgtttttatcaacaaaatgacccaagtatatgtctgatcagcttttcatcctttcaagttttgaggcatttttatcaacacaaagacccaagctaagcatatatgtatgcatggctattagtcattcttgtgatcttttagtaagctatagctacatagcaatcaatatgtatgcatatagtgtcagtttaattgtgatattttccctccgttctcgaaaacaattgacacttggcactactaagttttgatcactccttttctttcaaaaaatttataaacacttaaaatatgttatattattaaagtatgtagcgtagaaaatataaccatacaacttccattcatcatcatataattatttaaaagtaatttgtgatcaaagtaacagccgtagtactcaaccgtgtcaaccaagtcagttattcaagaactgagggagtaaatattgaatgcaaaattaatatgaaaattttttcttctgctatatatcctttttcagcgtacgtatgttcactcttctgaattgattacaacttagaaactcaaggtggatatatagcgaagaaatattaacatgttaacgtttaataaaattagatgaatttgttctctttttttttgtttcaagtgatgttgatttgtaccaaaatcagatggcatgtgtcacggtcaaacttattaattaaagagatttagcatgcaatcttgacaatcaaatctttacagagaatggcatttctatatatgaagccttacatgcatgtgcataaatatttttttggagctagagtgtggtagctttacgtgccactgcatcaaagacagatagatatttccagatttttaaatatctatttatctgtgtgttttgtctaagtaaattgaaggttttttaatataagctgtatgttttagctaaaaatgaaacaactgactcaaccatttggctttacttgcatgctagcttgaccaccatgg

SEQ ID NO: 112 - DNA, 880 bp, Oryza sativa
  misc_feature (1)..(880): AY177702 3'-regulatory sequence engineered
  misc_feature (1)..(282): 3'-untranslated sequence
  misc_feature (283)..(880): 3'-nontranscribed sequence
gactatgccgtacaagctggacgataagtgatcaatttcaaacaagcacaaagcctttcagatgcaagtagtatttttgtgatagctgagacaataaaaaagtgtacagactacagactggacagattatgttgtcggatgctcatgtaatgactgtggtgtaataagaaatacgtagtataagtttgtaaccctgcttactctctattgctttctagaaaagctcaaccaaaactctgaaaagtctttggactgaaaaggttgtaacaatgtttaccaggaaggtgctttggtgatgaaaaaagagttgtcactatgcctaagaaggaaggggtgtgagctactggcgaaaactgttatgtattgcacatggtgaataatggctgttgaacatgtctactcagacttaacagtcagcccttactcatggctgttcaagtggtgttacagatgaaggtgcatccaacccaattcaaagcagcaacactcatactggtgctgcaaataccgtgtatgctagagagaggtggttggatagaaggcccatgtatcatgtcatgtcattgattcacaatttcacgtgtcgcaacatttattattagtagtattctactgcaagtctgcaactaagaaataaatcttctgttaaacatgaacggctcctgatgcaatacactggagttaaccactaaaatctcagcaattgaaagttccacttagaaaagcccataccacattaaaatggtaatgcctgtatttaattgattttgaattaaaagtggtgctatcaactttgagttccaaaactaattatttccaaagaaaaaggtaattcaataattaccatcacttggtatagattggtcttctgtgacaacca

SEQ ID NO: 113 - DNA, 3341 bp, Oryza sativa
  misc_feature (1)..(3341): AY224482 5'-regulatory sequence
  misc_feature (1)..(1981): 5'-nontranscribed sequence
  misc_feature (1982)..(2163): Exon
  misc_feature (2164)..(3325): Intron
  misc_feature (3326)..(3341): Exon
tcttttcgcaaactaaacaaggccttaacatgctagaaatttagaaaattccacattaattgactataatccatcctaaattttcatccatggcatctaggaagagatcaataatgatgttgacaaccaaattcggcaccagattgattctattcataaattgcagaattaagagccattttcgtagaaggctgtggttaattagaccgcagtgcatatgccggtttgatcaggaccatggcagtctgatggccaatctgattggcgtggagcatgcggcctaaccggcaaactccgagtccgatagagtctcatgttcttctgcttgtttgagatttttttagtcctaatacattccaggacctacttacactacgagaattcagaatttgcttggtggccatctaatctctttggcggttcgacatcacctaaggtaaagtgtattcttatcggtctagactgccaaggttatatttcttgactattcgaaagtttaatattctccgtagttttcttggcggttagaccgccaataaaattttctctcacggttagcagccaagaaacctggattttcctgtcactctagacttggcggttggatgtcaaaatatattatcttagtggttttcatgctatccttggtggtttttggccgcgaagaaaattccgaattcttgtagtgttgggacgtggataggctttgtttatgtaagatcaacccctttataagagctataactaattcatcgagacaaccagcacacaatcaatcaaagaatcgttcttataccctttttctttacttctacccctttaaccctagttcatccatcttcatcaatttgcattgaaagccatccactttttgcggcgagagtacgaaatcttttataggtttgtcccaaaaatcttccgttccgtccatgatatggttgtttatccccaaattaatctaaattggttctgctagcctattttgattctatcaccgccaagatcagaagccacaccatctactttgggcaatggttcaagatcaagaggcaccactacttcatctacatcaacaataccggaggctcgatcggtttgtgtgtcgtcaaatagtcttttgtaacacgtatatggctccagcatggattcatgtccagctaattattgcaagcaaaatgagatgtgttgagtcctttcctatcacttacatgacactatacatattaatttttagcttatatgcaattctatagccagtattatgaatggggagtggtacctattttgagcaaacgatgaggtgtacaatatcgtactggaaaatgtaaaatgtacttatcatgagctgtagccgcactcataaccaatcaataactggcacaaggaaagccatggaacatctttacatggtctttcttgcggcatggttttaaagtagcaaattcgtgctaccgtatatgaacatgtgaccgtgacacaaaatcaagaaatccagaatgaacatggatcctaagcacatgacctcaccgatcgatcaccaccaaagcctttttccatttgtgtggcaataataattaaagttttgtatagtttagtacatggcgccggcgggtaattaagctgcagccacctgcatccgatccattcgtgcatataacctaaccacccatttcgccttctctccactctctctcctctccctctctctctctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaagtaagcaatccatcggatttataagtatatatgtatatttcccctaatttaattgtagtttccttagttgttctcggatctgctttgaagtctccttttgttcttgatttatttttgaaagaactctccttgttctttcacttgataggtatatatatctggttctggtaatctttcatccttttaagtttgagacgtttttatcaacaaaatgacccaagtatatgtctgatcagcttttcatcctttcaagttttgaggcatttttatcaacacaaagacccaagctaagcatatatgtatgcatggctattagtcattcttgtgatcttttagtaagctatagctacatagcaatcaatatgtatgcatatagtgtcagtttaattgtgatattttccctccgttctcgaaaacaattgacacttggcactactaagttttgatcactccttttctttcaaaaaatttataaacacttaaaatatgttatattattaaagtatgtagcgtagaaaatataaccatacaacttccattcatcatcatataattatttaaaagtaatttgtgatcaaagtaacagccgtagtactcaaccgtgtcaaccaagtcagttattcaagaactgagggagtaaatattgaatgcaaaattaatatgaaaattttttcttctgctatatatcctttttcagcgtacgtatgttcactcttctgaattgattacaacttagaaactcaaggtggatatatagcgaagaaatattaacatgttaacgtttaataaaattagatgaatttgttctctttttttttgtttcaagtgatgttgatttgtaccaaaatcagatggcatgtgtcacggtcaaacttattaattaaagagatttagcatgcaatcttgacaatcaaatctttacagagaatggcatttctatatatgaagccttacatgcatgtgcataaatatttttttggagctagagtgtggtagctttacgtgccactgcatcaaagacagatagatatttccagatttttaaatatctatttatctgtgtgttttgtctaagtaaattgaaggttttttaatataagctgtatgttttagctaaaaatgaaacaactgactcaaccatttggctttacttgcatgctagcatgaaaactgtgata

SEQ ID NO: 114 - DNA, 886 bp, Oryza sativa; identical to SEQ ID NO: 110
  misc_feature (1)..(886): AY224482 3'-regulatory sequence
  misc_feature (1)..(285): 3'-untranslated sequence
  misc_feature (286)..(886): 3'-nontranscribed sequence

SEQ ID NO: 115 - DNA, 3342 bp, Oryza sativa
  misc_feature (1)..(3342): AY224482 5'- regulatory sequence engineered
tcttttcgcaaactaaacaaggccttaacatgctagaaatttagaaaattccacattaattgactataatccatcctaaattttcatgcatggcatctaggaagagatcaataatgatgttgacaaccaaattcggcaccagattgattctattcataaattgcagaattaagagccattttcgtagaaggctgtggttaattagaccgcagtgcatatgccggtttgatcaggaccatcgcagtctgatggccaatctgattggcgtggagcatgcggcctaaccggcaaactccgagtccgatagagtctcatgttcttctgcttgtttgagatttttttagtcctaatacattccaggacctacttacactacgagaattcagaatttgcttggtggccatctaatctctttggcggttcgacatcacctaaggtaaagtgtattcttatcggtctagactgccaaggttatatttcttgactattcgaaagtttaatattctccgtagttttcttggcggttagaccgccaataaaattttctctcacggttagcagccaagaaacctggattttcctgtcactctagacttggcggttggatgtcaaaatatattatcttagtggttttcatgctatccttggtggtttttggccgcgaagaaaattccgaattcttgtagtgttgggacgtggataggctttgtttatgtaagatcaacccctttataagagctataactaattcatcgagacaaccagcacacaatcaatcaaagaatcgttcttataccctttttctttacttctacccctttaaccctagttcatccatcttcatcaatttgcattgaaagccatccactttttgcggcgagagtacgaaatcttttataggtttgtcccaaaaatcttccgttccgtccatgatatggttgtttatccccaaattaatctaaattggttctgctagcctattttgattctatcaccgccaagatcagaagccacaccatctactttgggcaatggttcaagatcaagaggcaccactacttcatctacatcaacaataccggaggctcgatcggtttgtgtgtcgtcaaatagtcttttgtaacacgtatatggctccagcatggattcatgtccagctaattattgcaagcaaaatgagatgtgttgagtcctttcctatcacttacatgacactatacatattaatttttagcttatatgcaattctatagccagtattatgaatggggagtggtacctattttgagcaaacgatgaggtgtacaatatcgtactggaaaatgtaaaatgtacttatcatgagctgtagccgcactcataaccaatcaataactggcacaaggaaagccaaggaacatctttacatggtctttcttgcggcatggttttaaagtagcaaattcgtgctaccgtatatgaacatgtgaccgtgacacaaaatcaagaaatccagaatgaacatggatcctaagcacatgacctcaccgatcgatcaccaccaaagcctttttccatttgtgtggcaataataattaaagttttgtatagtttagtacatggcgccggcgggtaattaagctgcagccacctgcatccgatccattcgtgcatataacctaaccacccatttcgccttctctccactctctctcctctccctctctctctctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatcgggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaagtaagcaatccatcggatttataagtatatatgtatatttcccctaatttaattgtagtttccttagttgttctcggatctgctttgaagtctccttttgttcttgatttatttttgaaagaactctccttgttctttcacttgataggtatatatatctggttctggtaatctttcatccttttaagtttgagacgtttttatcaacaaaatgacccaagtatatgtctgatcagcttttcatcctttcaagttttgaggcatttttatcaacacaaagacccaagctaagcatatatgtatgcatggctattagtcattcttgtgatcttttagtaagctatagctacatagcaatcaatatgtatgcatatagtgtcagtttaattgtgatattttccctccgttctcgaaaacaattgacacttggcactactaagttttgatcactccttttctttcaaaaaatttataaacacttaaaatatgttatattattaaagtatgtagcgtagaaaatataaccatacaacttccattcatcatcatataattatttaaaagtaatttgtgatcaaagtaacagccgtagtactcaaccgtgtcaaccaagtcagttattcaagaactgagggagtaaatattgaatgcaaaattaatatgaaaattttttcttctgctatatatcctttttcagcgtacgtatgttcactcttctgaattgattacaacttagaaactcaaggtggatatatagcgaagaaatattaacatgttaacgtttaataaaattagatgaatttgttctctttttttttgtttcaagtgatgttgatttgtaccaaaatcagatggcatgtgtcacggtcaaacttattaattaaagagatttagcatgcaatcttgacaatcaaatctttacagagaatggcatttctatatatgaagccttacatgcatgtgcataaatatttttttggagctagagtgtggtagctttacgtgccactgcatcaaagacagatagatatttccagatttttaaatatctatttatctgtgtgttttgtctaagtaaattgaaggttttttaatataagctgtatgttttagctaaaaatgaaacaactgactcaaccatttggctttacttgcatgctagcttgaaaaccaccatgg

SEQ ID NO: 116 - DNA, 880 bp, Oryza sativa; identical to SEQ ID NO: 112
  misc_feature (1)..(880): AY224482 3'-regulatory sequence engineered
  misc_feature (1)..(282): 3'-untranslated sequence
  misc_feature (283)..(880): 3'-nontranscribed sequence

SEQ ID NO: 117 - DNA, 6719 bp, Oryza sativa
  misc_feature (1)..(6719): AY250075 5'-regulatory sequence
  misc_feature (1)..(1685): 5'-nontranscribed sequence
  misc_feature (1)..(6719): n is a, c, g, or t
  misc_feature (370)..(370): n is a, c, g, or t
  misc_feature (1686)..(1873): Exon
  misc_feature (1874)..(6702): Intron
  misc_feature (6703)..(6719): Exon
gaaatggtttcattttgggacaagttattgtgctaaaaatagctattctagaaagataaaatttgaataagatgaattttttttaattgagagagtaattggggtaagacgaagagaaatttgaatgagataggattgaagtgacaagtactagtactctagaattgcatgcactgatttgaaaataaatttagattctgaaattgtgcttactcctttcgtaaaaaaaaactaacctatgattagatgtagcatatccttacaacaaatttgtacatgaacttatccaaattcattgtattaggatatatcacatccaatagtagatttggttttttttttggaccgggggggttatttgaaatggagncagtacatgactaatgacatctctcggtggctttttttttttcaaacaataaaaatttctacaagtgatgttgaatcctgttgtactccctcttttccataaaatcaatctaaaatggatggaatgtaagtatgtgaatgaatctaatataattttgtaccacgttgcgtggtggctgaaaggataacaccagacatggggacagacatacatactactactagtactccctccgtaaaagaaaagaacaaatctaagattggatgtgatattttctagaacaatgaataatagaagcttgtccagatttattatactaggaaatgtctcatcaaatactagattggtttttttttacggaggaaatatttaattattatagattaccatgttcaatcttttcatcaacaacaaaaatgtcaatggagtaatcgacggcaatccccggcagctataggccttgtttagttcccaaattttttttccctaaaaacattatatcgaatctttggacacatgatagcattaaatatagataaaaaactaattgcaaaagtttatatggaaatcgcgagacaaatcttttgagcctaattagtccataattagccataagtgctatacattaaccccatatgtgctaatgatggattaattaggcttaataaattcgtctcgcggtttccaggcgagttatgaaattagttttttccttcgtgtccaaaaacccccttccgacattcggtcaaacgtccgatgtgacacccagaaattttcttttcgcgatttaaacacatatataatagtagagtcaaaatatgccaagttggaatgaaaactttgcatgtcactttattaattattccactctcttgaggatctgaaacatacatagtatttattattataggggtgttcccatgttcaataatcttttcatcaacgagtacaatgtcaatatggatcagtaatcgacggcaagaccggggcaggcagctaggccggggaagaaaggaatctgcgctgcagtagcactctctgacctgtgggccccctacccccctcatctctctccaacgtacccacacagcgtcccacctcgccgccggagccaatgagagatcgacgacgatcgacgtctaccagtccacgaacgagtacaattcgccataaataaatagggcgccacacccctcagctcgatcccctagctctcgatcggctgcaagaagctatagctagcctagctcatctcgccggagaagaagctaaggcagcaggcagagagagagagagagagagagagagagagatgatggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaacctcttccactacgcctcctcccacaccacgtacgtcactatcactactcctgctgcattttccatacaatacgtacaaaataacaaaagcagtagatatatatagttagctcaattaatatgatggattatttcagaaacatttaacttctctctctctctctctctctctcttccctggcatgcatcgtccatgtatcaaattaaaagatgatcaagaatgcaatgtgaaaaatatataacaacccgtgtacacctgtgagtttacaaatacaagcatttcaagcgttcataatttatccatccataaatataagtgttacaggatatactacttattctatcgtctatcacccttctttcaaacttcctccggatgcatgcatatcgatccctcattcaacaagggatattttagtcgctaaacaaattataaatacctatattaattcatcgatagagggggagttagcaagtactccctctgtcccacaatgctggtcgtccaaggaatgtagagaaaataattgctctggatgaaacttaccaggatgccccaaaacattagttgcagtagtcattttaacacaagtacaccagccacataatggtgccatacacctaatttgaatgctttggcacctagaaatttgacaggagcactagatggtgctagggatgaaaacggagcggatacggacggataatgctcataccatattcgttttcatattttttaccggatacgaaaacgaatacggatagctcgaatacggaaacaaatacggattatctcgaatacgaataagaatcgaatatgatcggacacgaatacggaaacaaatttttctcgaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaacgtatattgaaggtcatagagttagaaagaaatggggtatgtctcatgggtcctgcggatatccgaatagcactgttcaccggatatccgaattattatccgtatccgacagaaaccttggtaccatatttgtattcgtatccgggagaaaatatccgtattcgtatccgtatccgaactatccgagaattatctgatccgaaaggtatccgtatccatttttgtccggagcggacggaaactatccgctccgttttcatccctagatggtgccacttttctgcgccattattactgccgatgggcgagtacaacgtcaaccattctaggatatttgttagccagtaaaacgatctcctttgtgggagggaggaagtagacattgtacacttcatagggcctgtttggagaactatctcagggatatttttttgctaaagattatcccaccaaaatagccctcttgctgtttggatccaagggctatttagctattattgtaccatcccaatcatttgtctccactaaaagtatacaacagccggatcttctatagctaatccaatacaggcacatacaagcatacacaattccttacaagcacaaactcataatttgtctcaaatgtataagcaagtccgtaaaataattgcacgccaaccgcggcccccacgtccgcggtcgcggccacagttggttgccatggcgcgttgccgacggcgacccattgcccctgatgaggagctgcctcgcccagggctgccgccgtctatgcccgatgactacccaccttttccaccgtgtccagcacggtcacctgccgcgccgaagttgagccggcgggagcgcggtgcaccacgagacggcccggcgggcgcgtggtgcaccacgagacggcccggtgccctatcgaccagcccttactcccagagagcgtggtgcgcggatgggagggagaccggagcctcggccatggccagctccttcctcgccgccaccctggaggaaggcactgtactcgtggaggtgagggaactcctggcccgacgacgcctgggtgttgaggtccagcgtgtccacgccggtgcggggaacggatccgtgggaagggccggacgccgacggctgcgagggccaaatgttgccggcggcggacgaaatgggatcttgggagaagaaatcgaagccgttggggtccatctccgcgcggattcggtgcacagcgatgcgtcgacgacggatctgatggccggcaacgcgggtggggtgagttgccagtgtggatgcctctcggtggatctgaaggaaggggcagcgcgattcgagggagagggcggcgcgggtgaagggccgggcggcggcgtgggtggggggagggggaggagaagctagggccgggcggcggcgcgggtgtggggagggggaggcgaagctgggccgggcggcggcgagggttctagagagtgagcgggggcgacagcgagcgggggcgaaatgcgatgggttttgccgcaacgggatcggcacaagtgggggaaagtgggaatcggtggggcccacagcaaaatagccccaattagcacccggtgggggtgataattttttggggtgggctatttgcaaatagccctaaaatagccctcctgtttggatccccttgagctattttggggttaaaaggggtgggctaaaaaatatccctaggatccaaacaccgccatagaacgatattatgcatagagattctccttactatcttgtaccaccggtaagtacacggcaataatttgctgagccagctttatttcctcttatgggaactgttatacctgcccaggggtactatttttggtagatgcatgtcggccccattcttctcttgtcctagtatatgcagtattaccttagtcctattgcatatactacattcgtcctattttaagtgcatctatagtttttcgtgcctaacttcgattgttgtcttatttagaaaaaaaaattaaaaatataagtcacacataagatacttatcatgttttatcatcttataacaataaaaatactaattataaaaaaaatttaaataagacggacgattaaaattggacacgaaaactcatgggctacactaaaacgagacggatagagtagtattaatagagtagtattaggaacagccttttgacttgtctacggcaatgcacaaatagtaatcaatataatctaatcatatcttttattgataggaacaattgtttgcacagtactgatatatgtatattttttttcatgttatttcagatcatatacatgaaactcataatcaaccttctattctgttgatttatataattaataatttgaatctgtagacaatccagatcatgctatatggagtataacattattaattgcctctttgtaaataaccattatcagaactatatattcatcttcaaactttgatcactactcgttctttaaaagacaaatacttaaaaatgtattatcaaagtgtgccgcattaatcgtgaaatagttttcgtttatcatagtctaaccatttgcaagatattagatgcatcctcttgttttctctcaatccctccaactcaactcaaattgtactcagtgatgccattccttttacacaattaattgcatgatgttacacttacacaccattgtttacgccctaacgaaactaatgtgtagtgcacgtaaaacgaagcgattcattagcgcataattaattaagtatttagttttttttaaaagggattaatatgattttttttaaaacaactttggtgtagaaattttttttaaaaatgtactgtttaatagtttaggaagcgtgcgcgcggaaaacaagaagaaggaagttaggaaccgaagtaacaaacacaaccttagggcactcccaaccctccacctagtatgatgtctatggcattaactacattgccatgtaggacttttagcttatgtggcactatattaattaagagagagggagtgaagagaggaagaaactgggtctcatgcaagacacagcttcaacacgagaacctatgcactagacactatcaagttttgcattgggagagaatagtgtcttcataatagatgaaaaataaatatgattggtagagaagagatatgatgtatttattaatggtctattattttaagaaaccatggattatatagtgtagtgtgatttcttattgacatggcaccatagacactgcttatggacaatatggattgggactgtctttaatccaatcaaaccaaggccaccccgtgaatgttcactgcatacgcatagcactattcacatgagacagacccatggctgggcctaccaaccgtcacatattgatctggaaggacatgcactattcagcgcgtgtgagatgcccaatcaaagaaataactgaaattgatgtagataatttgtttacttaaacaccgtgggaacgctggaaagttaggggtgccacgtcagatgttacttttgtaaaaaagcccccgcagttctgttaattatgcattggtccccgctgataatttatagtataaattagctaggtttggctatcgttgagcattggccgaaattctattctattaactaaacaaattagctaggtgacttgaagtgaagtgagtgtactcaccatccaattatagttaattagggtctgtttattttgttgccactttcgattcattaatattcatgtgtgagggcgggaatattgtgaacattttaagttagttttttttattagaggaagtatatcctaataattgattctcatattttattgatagtatggagcgaatccttg

SEQ ID NO: 118 - DNA, 674 bp, Oryza sativa
  misc_feature (1)..(674): AY250075 3'-regulatory sequence
  misc_feature (1)..(299): 3'-untranslated sequence
  misc_feature (300)..(674): 3'-nontranscribed sequence
tagaagatgttcagatgaaatggtccctgcagccattgcatggttgctgaataatgtcgtcccagatggttaggcaagcaacctagctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatcacttcgatctggtattctattggtcagtctaatgagtgtaccttctagtactcagttttgtctgaattgtttcacaggcaaacagaaaaggcatacttttctccgttcaaatatagtaatctagtactccctcagttttcgtttcataacgtaagactttctaatattgtccatattcatatgggtgttaataaatctagatacatatgtgtgtctagattcattaatatttatatgaatatgggtaatgctagaaattcttacgttatgaaacggaagaagtactagaaagtcttacgtactctatggtgtgtctaacctagtagtagattgctactccctccgtccctaaatatttgacgccggtgattttttt

SEQ ID NO: 119 - DNA, 6720 bp, Oryza sativa
  misc_feature (1)..(6720): AY250075 5'-regulatory sequence engineered
  misc_feature (1)..(6720): n is a, c, g, or t
  misc_feature (370)..(370): n is a, c, g, or t
gaaatggtttcattttgggacaagttattgtgctaaaaatagctattctagaaagataaaatttgaataagatgaattttttttaattgagagagtaattggggtaagacgaagagaaatttgaatgagataggattgaagtgacaagtactagtactctagaattgcatgcactgatttgaaaataaatttagattctgaaattgtgcttactcctttcgtaaaaaaaaactaacctatgattagatgtagcatatccttacaacaaatttgtacatgaacttatccaaattcattgtattaggatatatcacatccaatagtagatttggttttttttttggaccgggggggttatttgaaatggagncagtacatgactaatgacatctctcggtggctttttttttttcaaacaataaaaatttctacaagtgatgttgaatcctgttgtactccctcttttccataaaatcaatctaaaatggatggaatgtaagtatgtgaatgaatctaatataattttgtaccacgttgcgtggtggctgaaaggataacaccagacatggggacagacatacatactactactagtactccctccgtaaaagaaaagaacaaatctaagattggatgtgatattttctagaacaatgaataatagaagcttgtccagatttattatactaggaaatgtctcatcaaatactagattggtttttttttacggaggaaatatttaattattatagattaccatgttcaatcttttcatcaacaacaaaaatgtcaatggagtaatcgacggcaatccccggcagctataggccttgtttagttcccaaattttttttccctaaaaacattatatcgaatctttggacacatgatagcattaaatatagataaaaaactaattgcaaaagtttatatggaaatcgcgagacaaatcttttgagcctaattagtccataattagccataagtgctatacattaaccccatatgtgctaatgatggattaattaggcttaataaattcgtctcgcggtttccaggcgagttatgaaattagttttttccttcgtgtccaaaaacccccttccgacattcggtcaaacgtccgatgtgacacccagaaattttcttttcgcgatttaaacacatatataatagtagagtcaaaatatgccaagttggaatgaaaactttgcatgtcactttattaattattccactctcttgaggatctgaaacatacatagtatttattattataggggtgttcccatgttcaataatcttttcatcaacgagtacaatgtcaatatggatcagtaatcgacggcaagaccggggcaggcagctaggccggggaagaaaggaatctgcgctgcagtagcactctctgacctgtgggccccctacccccctcatctctctccaacgtacccacacagcgtcccacctcgccgccggagccaatgagagatcgacgacgatcgacgtctaccagtccacgaacgagtacaattcgccataaataaatagggcgccacacccctcagctcgatcccctagctctcgatcggctgcaagaagctatagctagcctagctcatctcgccggagaagaagctaaggcagcaggcagagagagagagagagagagagagagagagatgaaggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaacctcttccactacgcctcctcccacaccacgtacgtcactatcactactcctgctgcattttccatacaatacgtacaaaataacaaaagcagtagatatatatagttagctcaattaatatgatggattatttcagaaacatttaacttctctctctctctctctctctctcttccctggcatgcatcgtccatgtatcaaattaaaagatgatcaagaatgcaatgtgaaaaatatataacaacccgtgtacacctgtgagtttacaaatacaagcatttcaagcgttcataatttatccatccataaatataagtgttacaggatatactacttattctatcgtctatcacccttctttcaaacttcctccggatgcatgcatatcgatccctcattcaacaagggatattttagtcgctaaacaaattataaatacctatattaattcatcgatagagggggagttagcaagtactccctctgtcccacaatgctggtcgtccaaggaatgtagagaaaataattgctctggatgaaacttaccaggatgccccaaaacattagttgcagtagtcattttaacacaagtacaccagccacataatggtgccatacacctaatttgaatgctttggcacctagaaatttgacaggagcactagatggtgctagggatgaaaacggagcggatacggacggataatgctcataccatattcgttttcatattttttaccggatacgaaaacgaatacggatagctcgaatacggaaacaaatacggattatctcgaatacgaataagaatcgaatatgatcggacacgaatacggaaacaaatttttctcgaacacgaaaaccaactcaacttctaatggaaacaaatatcaacatatataattagctcattttatataaaatgaggtataatttataaatattttttaaaatttaaataatattaatagtatggactagtgttaagagataaactactattaaaatctataaacgtatattgaaggtcatagagttagaaagaaatggggtatgtctcatgggtcctgcggatatccgaatagcactgttcaccggatatccgaattattatccgtatccgacagaaaccttggtaccatatttgtattcgtatccgggagaaaatatccgtattcgtatccgtatccgaactatccgagaattatctgatccgaaaggtatccgtatccatttttgtccggagcggacggaaactatccgctccgttttcatccctagatggtgccacttttctgcgccattattactgccgatgggcgagtacaacgtcaaccattctaggatatttgttagccagtaaaacgatctcctttgtgggagggaggaagtagacattgtacacttcatagggcctgtttggagaactatctcagggatatttttttgctaaagattatcccaccaaaatagccctcttgctgtttggatccaagggctatttagctattattgtaccatcccaatcatttgtctccactaaaagtatacaacagccggatcttctatagctaatccaatacaggcacatacaagcatacacaattccttacaagcacaaactcataatttgtctcaaatgtataagcaagtccgtaaaataattgcacgccaaccgcggcccccacgtccgcggtcgcggccacagttggttgccaaggcgcgttgccgacggcgacccattgcccctgatgaggagctgcctcgcccagggctgccgccgtctatgcccgatgactacccaccttttccaccgtgtccagcacggtcacctgccgcgccgaagttgagccggcgggagcgcggtgcaccacgagacggcccggcgggcgcgtggtgcaccacgagacggcccggtgccctatcgaccagcccttactcccagagagcgtggtgcgcggatgggagggagaccggagcctcggccatgcccagctccttcctcgccgccaccctggaggaaggcactgtactcgtggaggtgagggaactcctggcccgacgacgcctgggtgttgaggtccagcgtgtccacgccggtgcggggaacggatccgtgggaagggccggacgccgacggctgcgagggccaaatgttgccggcggcggacgaaatgggatcttgggagaagaaatcgaagccgttggggtccatctccgcgcggattcggtgcacagcgatgcgtcgacgacggatctgatggccggcaacgcgggtggggtgagttgccagtgtggatgcctctcggtggatctgaaggaaggggcagcgcgattcgagggagagggcggcgcgggtgaagggccgggcggcggcgtgggtggggggagggggaggagaagctagggccgggcggcggcgcgggtgtggggagggggaggcgaagctgggccgggcggcggcgagggttctagagagtgagcgggggcgacagcgagcgggggcgaaatgcgatgggttttgccgcaacgggatcggcacaagtgggggaaagtgggaatcggtggggcccacagcaaaatagccccaattagcacccggtgggggtgataattttttggggtgggctatttgcaaatagccctaaaatagccctcctgtttggatccccttgagctattttggggttaaaaggggtgggctaaaaaatatccctaggatccaaacaccgccatagaacgatattatgcatagagattctccttactatcttgtaccaccggtaagtacacggcaataatttgctgagccagctttatttcctcttatgggaactgttatacctgcccaggggtactatttttggtagatgcatgtcggccccattcttctcttgtcctagtatatgcagtattaccttagtcctattgcatatactacattcgtcctattttaagtgcatctatagtttttcgtgcctaacttcgattgttgtcttatttagaaaaaaaaattaaaaatataagtcacacataagatacttatcatgttttatcatcttataacaataaaaatactaattataaaaaaaatttaaataagacggacgattaaaattggacacgaaaactcatgggctacactaaaacgagacggatagagtagtattaatagagtagtattaggaacagccttttgacttgtctacggcaatgcacaaatagtaatcaatataatctaatcatatcttttattgataggaacaattgtttgcacagtactgatatatgtatattttttttcatgttatttcagatcatatacatgaaactcataatcaaccttctattctgttgatttatataattaataatttgaatctgtagacaatccagatcatgctatatggagtataacattattaattgcctctttgtaaataaccattatcagaactatatattcatcttcaaactttgatcactactcgttctttaaaagacaaatacttaaaaatgtattatcaaagtgtgccgcattaatcgtgaaatagttttcgtttatcatagtctaaccatttgcaagatattagatgcatcctcttgttttctctcaatccctccaactcaactcaaattgtactcagtgatgccattccttttacacaattaattgcatgatgttacacttacacaccattgtttacgccctaacgaaactaatgtgtagtgcacgtaaaacgaagcgattcattagcgcataattaattaagtatttagttttttttaaaagggattaatatgattttttttaaaacaactttggtgtagaaattttttttaaaaatgtactgtttaatagtttaggaagcgtgcgcgcggaaaacaagaagaaggaagttaggaaccgaagtaacaaacacaaccttagggcactcccaaccctccacctagtatgatgtctatggcattaactacattgccatgtaggacttttagcttatgtggcactatattaattaagagagagggagtgaagagaggaagaaactgggtctcatgcaagacacagcttcaacacgagaacctatgcactagacactatcaagttttgcattgggagagaatagtgtcttcataatagatgaaaaataaatatgattggtagagaagagatatgatgtatttattaatggtctattattttaagaaagcatggattatatagtgtagtgtgatttcttattgacatggcaccatagacactgcttatggacaatatggattgggactgtctttaatccaatcaaaccaaggccaccccgtgaatgttcactgcatacgcatagcactattcacatgagacagacccatgcctgggcctaccaaccgtcacatattgatctggaaggacatgcactattcagcgcgtgtgagatgcccaatcaaagaaataactgaaattgatgtagataatttgtttacttaaacaccgtgggaacgctggaaagttaggggtgccacgtcagatgttacttttgtaaaaaagcccccgcagttctgttaattatgcattggtccccgctgataatttatagtataaattagctaggtttggctatcgttgagcattggccgaaattctattctattaactaaacaaattagctaggtgacttgaagtgaagtgagtgtactcaccatccaattatagttaattagggtctgtttattttgttgccactttcgattcattaatattcatgtgtgagggcgggaatattgtgaacattttaagttagttttttttattagaggaagtatatcctaataattgattctcatattttattgatagtatcgagcgccaccatgg

SEQ ID NO: 120 - DNA, 671 bp, Oryza sativa
  misc_feature (1)..(671): AY250075 3'-regulatory sequence engineered
  misc_feature (1)..(296): 3'-untranslated sequence
  misc_feature (297)..(671): 3'-nontranscribed sequence
aagatgttcagatgaaatggtccctgcagccattgcatggttgctgaataatgtcgtcccagatggttaggcaagcaacctagctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatcacttcgatctggtattctattggtcagtctaatgagtgtaccttctagtactcagttttgtctgaattgtttcacaggcaaacagaaaaggcatacttttctccgttcaaatatagtaatctagtactccctcagttttcgtttcataacgtaagactttctaatattgtccatattcatatgggtgttaataaatctagatacatatgtgtgtctagattcattaatatttatatgaatatgggtaatgctagaaattcttacgttatgaaacggaagaagtactagaaagtcttacgtactctatggtgtgtctaacctagtagtagattgctactccctccgtccctaaatatttgacgccggtgattttttt

SEQ ID NO: 121 - DNA, 2478 bp, Oryza sativa
  misc_feature (1)..(2478): L37527 5'-regulatory sequence
  misc_feature (1)..(2003): 5'-nontranscribed sequence
  misc_feature (2004)..(2311): Exon
  misc_feature (2312)..(2462): Intron
  misc_feature (2463)..(2478): Exon
gccaagagagcccccttgctgctggtgggggagtatttatactcccacccaccaaaactagccgttgggggcgaaatcccccaactctgtgctctgtcggtctgaccggaggtatgtggccggtcagaccgtgctactctgcaacggctagaaaactagccgttgtagccctgtcagagggccccatcggcctggccggtcagaccggcatggggtggccggtcagaccggcctcggctcggtcagaccgccatcagttcggtctgaccgaatacggcttcgtcggctctgtatcggccatcccgagcagcaccatctcggcctccagggggccggtctgaccgggaaagtgccgccggtcagaccgtcactatgtagccggtctgaccggccagggcacgctggtcagaccgccactatgtggccggtctgaccgcccctggtcaggccgaacccagtgaatttgcaagtgaatgtgtgtgtaatgaaaaagagagcacaaatgaaaatgcaatgacctaatgtggcaattaaaatcatctctttgctaggtcattacccctcttaatagtacggcgaaactaaaattaaactggcaaatttgatcgccctacacctcgatcaattctaaattaaagcgctagttttaccgtcttctttccctttgctttgcgccgtcaattttaatccatcgataatcatccatgcgcacatatgacgtggacctaacttaaaatatatagctcaaagacaacggttagtccacaattaatgcttgtcattaattaccaaaattaacaccgggggcctagatgcttcagcggtggcacggcgaagtggcggccggggaagcggcagcggctgagccggctggcggctttgcgttttttctctttttttttaagaatttgtgatctatgtataggttgagatgaagaatttgtgattcattgcatgaattgagatgtataatttcttttttagaatctgtgattcattgcatgaatctgagatgtatatgatttgtgtatttgggatgtttatttgatttggggtttgatttgggatctataatctgtggtgtatatgattgatttgtgtatttgggatgttactttgatttggggtttgatttaggaatatgcatcccacataatttgggagaaaataaattagagattgagtagtaagtagcaataaatgaaaataaaaaaactaaccaggactgcctctcccatctttagtcccgagtatttgaatcgggactaaggccctgtttgattcagcttaagattattataatctggattattaggagtaagctgaaacaaacaagtagattattatgctatattattataatatataagtcagattactataatccaataatctcctctagggaagctttttccatattattgagtggctaaagacccactatccttagatgcctctaataatccagagaaacaaacaactcgtagcttattttatattagcttattataattcagcttagagcaatctgatttaataatctagattacaataatcttaagctgaaacaaacagggcctaaagatagggatctttagtcctgaattcgtagtcccgaaactacaaggggttacgaaccgggactaaaaacaatttctccactagtggatgctcaccatgtgtcattctcatttccatctcagtcccacgcaaaccaggtcagctcaagctcaagcaccgagccctacccctacgtcgatcgatctgcacggactgcacccggtcgaaacgtagccaggcaatggcgcaatgcaccacgcgagagagagagagagagagagagagagagagcagtttccatttccggcgctccagccctgccccaccgcgaaagcccccctcacctccattccttccatggcggcctccctcctcctcctccactgcaccctcctttactactccactccaaccatggcgtccagtcgtccacaccccccaccatccccaccttaaagaccggaagaacggcaactccccaaccctcttgtttcttcgagagcgaggtgaagatttgtttcttggtttgtgttcttggagtggaggaggaggaggagttggatatggggcgcggcaagatcgagatcaagaggatcgagaactcgacgaaccggcaggtgacgttctcgaagcgccgcgccgggatactcaagaaggcccgcgagatcggcgtgctctgcgacgccgaggtcggcgtcgtcatcttctccagcgccggcaagctctccgactactgcacgcccaagaccacgtccgtgtttcccccgtctctctctctcctcttccttgtttttttttcttttcttcttttcttgctcttaatttcagtgtttcctgagatatgcatgttctctttgcattgtgtttggcctttaatttgatttgtttttttggcgttttaggctgtcaaggatcttg

SEQ ID NO: 122 - DNA, 976 bp, Oryza sativa
  misc_feature (1)..(976): L37527 3'-regulatory sequence
  misc_feature (1)..(459): 3'-untranslated sequence
  misc_feature (460)..(976): 3'-nontranscribed sequence
taggctgctgagcactgccaatttggctgaacctcctgcttgctagctttgcatttcctcatgcgctgctagatgtatctgtggtttctctcatgcctgtctgaatgaactcacactgatgagagggtgtcagttgttttgtgctcctcccagcattagcactcagaattcagaaatgactcaatgtcagttgcttttgtgcttctcccagcattagcactcagaattcagaaatgactcaatgtcagttgcttttgtgcttctccctgcttgtttaattagccactgttcttgtttccagatggtgaacagtcagtttgtattatctagttatcttggcaaggatcagtaaaattcacaagtagcagccaactctgataataattccatctgtttcatcgcttggaatgaattgtatgggaaaaaaaaatcaatgcaaatcaagagataacgaaacatatgattctggagttcaattgaccagaatttgcaagagcactacatccatatcggctattgttcttatctagtaggctgtatgattcttgaattcgccaagaaaaagatcacctcctcctacatcacctgagcatgtcgccattgtcaatgaacgggccactgaacgccggcgaggcgctgaagttgctcccggcctcgctgaacatggcgctgtgcccgtacggcagcggccggtccggcagctccgggatgtccatgtccccctccagcatcttcaccgcctcggtgatggtcggccggagcgccaccatgacgtgcgcgcacaggatcccgacgagcacgaacctctccatggcgccgccccgggggctgtccgcagtcgacagcgcgccgtcgagcacctccctcgcctgcccggccttgacgtgcgcccacgcccagtcggtgatcagcacggggcccgacggcgccgacatgtccaggacgcgccgcgcgctcagcacctcgagcaccagca

SEQ ID NO: 123 - DNA, 2479 bp, Oryza sativa
  misc_feature (1)..(2479): L37527 5'-regulatory sequence engineered
gccaagagagcccccttgctgctggtgggggagtatttatactcccacccaccaaaactagccgttgggggcgaaatcccccaactctgtgctctgtcggtctgaccggaggtatgtggccggtcagaccgtgctactctgcaacggctagaaaactagccgttgtagccctgtcagagggccccatcggcctggccggtcagaccggcatggggtggccggtcagaccggcctcggctcggtcagaccgccatcagttcggtctgaccgaatacggcttcgtcggctctgtatcggccatcccgagcagcaccatctcggcctccagggggccggtctgaccgggaaagtgccgccggtcagaccgtcactatgtagccggtctgaccggccagggcacgctggtcagaccgccactatgtggccggtctgaccgcccctggtcaggccgaacccagtgaatttgcaagtgaatgtgtgtgtaatgaaaaagagagcacaaatgaaaatgcaatgacctaatgtggcaattaaaatcatctctttgctaggtcattacccctcttaatagtacggcgaaactaaaattaaactggcaaatttgatcgccctacacctcgatcaattctaaattaaagcgctagttttaccgtcttctttccctttgctttgcgccgtcaattttaatccatcgataatcatccatgcgcacatatgacgtggacctaacttaaaatatatagctcaaagacaacggttagtccacaattaatgcttgtcattaattaccaaaattaacaccgggggcctagatgcttcagcggtggcacggcgaagtggcggccggggaagcggcagcggctgagccggctggcggctttgcgttttttctctttttttttaagaatttgtgatctatgtataggttgagatgaagaatttgtgattcattgcatgaattgagatgtataatttcttttttagaatctgtgattcattgcatgaatctgagatgtatatgatttgtgtatttgggatgtttatttgatttggggtttgatttgggatctataatctgtggtgtatatgattgatttgtgtatttgggatgttactttgatttggggtttgatttaggaatatgcatcccacataatttgggagaaaataaattagagattgagtagtaagtagcaataaatgaaaataaaaaaactaaccaggactgcctctcccatctttagtcccgagtatttgaatcgggactaaggccctgtttgattcagcttaagattattataatctggattattaggagtaagctgaaacaaacaagtagattattatgctatattattataatatataagtcagattactataatccaataatctcctctagggaagctttttccatattattgagtggctaaagacccactatccttagatgcctctaataatccagagaaacaaacaactcgtagcttattttatattagcttattataattcagcttagagcaatctgatttaataatctagattacaataatcttaagctgaaacaaacagggcctaaagatagggatctttagtcctgaattcgtagtcccgaaactacaaggggttacgaaccgggactaaaaacaatttctccactagtggatgctcaccatgtgtcattctcatttccatctcagtcccacgcaaaccaggtcagctcaagctcaagcaccgagccctacccctacgtcgatcgatctgcacggactgcacccggtcgaaacgtagccaggcaatggcgcaatgcaccacgcgagagagagagagagagagagagagagagagcagtttccatttccggcgctccagccctgccccaccgcgaaagcccccctcacctccattccttgcatggcggcctccctcctcctcctccactgcaccctcctttactactccactccaacgatggcgtccagtcgtccacaccccccaccatccccaccttaaagaccggaagaacggcaactccccaaccctcttgtttcttcgagagcgaggtgaagatttgtttcttggtttgtgttcttggagtggaggaggaggaggagttggatatcgggcgcggcaagatcgagatcaagaggatcgagaactcgacgaaccggcaggtgacgttctcgaagcgccgcgccgggatactcaagaaggcccgcgagatcggcgtgctctgcgacgccgaggtcggcgtcgtcatcttctccagcgccggcaagctctccgactactgcacgcccaagaccacgtccgtgtttcccccgtctctctctctcctcttccttgtttttttttcttttcttcttttcttgctcttaatttcagtgtttcctgagatatgcatgttctctttgcattgtgtttggcctttaatttgatttgtttttttggcgttttaggctgtcaaccaccatgg

SEQ ID NO: 124 - DNA, 973 bp, Oryza sativa
  misc_feature (1)..(973): L37527 3'-regulatory sequence engineered
  misc_feature (1)..(456): 3'-untranslated sequence
  misc_feature (457)..(973): 3'-nontranscribed sequence
gctgctgagcactgccaatttggctgaacctcctgcttgctagctttgcatttcctcatgcgctgctagatgtatctgtggtttctctcatgcctgtctgaatgaactcacactgatgagagggtgtcagttgttttgtgctcctcccagcattagcactcagaattcagaaatgactcaatgtcagttgcttttgtgcttctcccagcattagcactcagaattcagaaatgactcaatgtcagttgcttttgtgcttctccctgcttgtttaattagccactgttcttgtttccagatggtgaacagtcagtttgtattatctagttatcttggcaaggatcagtaaaattcacaagtagcagccaactctgataataattccatctgtttcatcgcttggaatgaattgtatgggaaaaaaaaatcaatgcaaatcaagagataacgaaacatatgattctggagttcaattgaccagaatttgcaagagcactacatccatatcggctattgttcttatctagtaggctgtatgattcttgaattcgccaagaaaaagatcacctcctcctacatcacctgagcatgtcgccattgtcaatgaacgggccactgaacgccggcgaggcgctgaagttgctcccggcctcgctgaacatggcgctgtgcccgtacggcagcggcccgtccggcagctccgggatgtccatgtccccctccagcatcttcaccgcctcggtgatggtcggccggagcgccaccatgacgtgcgcgcacaggatcccgacgagcacgaacctctccatcgcgccgccccgggggctgtccgcagtcgacagcgcgccgtcgagcacctccctcgcctgcccggccttgacgtgcgcccacgcccagtcggtgatcagcacggggcccgacggcgccgacatgtccaggacgcgccgcgcgctcagcacctcgagcaccagca

SEQ ID NO: 125 - DNA, 2443 bp, Oryza sativa
  misc_feature (1)..(2443): L37528 5'-regulatory sequence
  misc_feature (1)..(1967): 5'-nontranscribed sequence
  misc_feature (1968)..(2098): Exon
  misc_feature (2099)..(2429): Intron
  misc_feature (2430)..(2443): Exon
accacctcaatctccactgtttgattggacgtttaggtttcatatcaccaaggttcaatcagtgtggagtacttttcagtccttctggcctgtgccaaatgtagaaggagagccttttctctgatttgatccattcttgcaagctacaggtaagttgatttgattccacatagaattatttttcttctttgtttttccatgccttttcttctctgtcataaactcctaatttagctactataattttttcagtgaatcctagctaagagttagtttattgttctttttaggtactgaattttggtacatactagcaaattgtcatatacagcaacaaggatctagtggcatgagactttggcaagtgttcttgcagaaaccaaaatcagagctgcctccatttggctgaataattctggccatttctaaccgttcctcattgcttttctccttatgcatatactggaaaggtagctctgcaaaagtcaggtagacaataacactagaagcagttatatatgcttgcaaaaattcacaacctttccaaacaaaatttatttcttacaccattccaccaggaatggaatttcaatactaccttgccaagtgcagttacaaaatgttcaccaaaacgtccaaaccttcgctgcaactttaatttggacataattcatatatacttgctagtatagcaacaggaatgctgcatagtgacaacacatctaggatcatgtcccaactctgatagatccattacaccaacctatcttgagacagtgccaatgcaggaactaacctctcatggaaatgcatggtagctagctccacaatgtgacacatgtaagtctcaagttcaccgtgcgaaaaatcacgatgcgcgaatcgcccccccaatttcgacaggtaagggtagatcttcatcgatcggccagttgaaaacaacaacggcggtacaacgatcggccatcatcgtgcaccgcaccgcggcggtggcccagagccggtgatggggatgtatggacggtggagtgagtggagagagggttggcagcaagcatgatgcatcacattatgtgaggaagagataggggccccatgagagcaactgaaaggactgtgctgaattaataggaggctgctgctggtgagtacttagccattatctctgcatcctatgtgacaaacagaaactggacagtgtatgtggagtgtcacatggttgtatatacatcatacattaaatcatctctatgctgtatatatagatttgctttgtttttactctctgatgatctgatcggtagaataaagcaactagttatcagttattatatatcacacaaattaaataggaaagtaatttgatttgctgaattggaaactacagtaaaacttgttaggtgagttctgaaaaaaaaagtgcatctgctgaacttcattggcaaaacaatgtaaagcccttggcattaacatctgtaacattgtctcagatatatcagcttacaaggttcctgaactgtgaaaagtgaaacaaaaaggaggaaagcaataaccggtcttgctgttcccacaactgtttttttgtgtctaacatgcagtttaccagtccaaacaaagcaagtttcagacttacagcaacaagaagcaaagctttgcaagcagagttacatcagagttacttgcattacatattctgaggtaaaatggatatggagacatatgtatctgacagcacagcactgcctgccaggacaagagatcaaagagtaaagactgatggaaagagagctagctagtagtaaatcagaaaggttgtggattgcagtcagaagaaacaacaagctagagatagatagctatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatggtaaattctggctttcttgcttttggataaattttgcttcctttcttaacttgagcacaagcttgtgttatatgtggtgtggaatcttggttgccatgttgtgaggatttagctagagagtcaagaaagaggaatatatgctttatgtagataggagtaggatctctgggtctttaaacatcaccatgacaagcaaagataagaacaggagagcagttcttgattattatttttcttctcatcaagaaattaagccggagatagacatggcagctgcacgcagtgattcacttcttgatttcttgatttgggttgttgcgtttgtgtccagaccgatctgagctg

SEQ ID NO: 126 - DNA, 1435 bp, Oryza sativa
  misc_feature (1)..(1435): L37528 3'- regulatory sequence
  misc_feature (1)..(31): 3'-untranslated sequence
  misc_feature (32)..(439): Intron
  misc_feature (440)..(869): Exon
  misc_feature (870)..(1435): 3'-nontranscribed sequence
tagttttggtgtagacaccgtacgtacacacgtacgttaggtaaataaaacactcagtactgtagatttatacctacacaaaagtatatatttgcagagtataatccagttaggcaagttgatatttaccctctgctatttttacataactgccagcggatactatttactttcgaactttggcaactcgtctttggaaatgataaaatgttattaaagtgtgctatatcttaaatacaagcatcggacttttgttcactttggtctaacaatttgagagaaaacaatgttcaatattcaaatggaaagtaaatgttgtcagttatttagaaacgaagggagtatatgtattactggcattcatcttaataattaactcagtaactgtttcttacatctcttgtagttgaaatctgaaagtgtgttgtatctgttgcagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatatatatatatatatatatatatatatatatatatatatatatatatatatatatatatataaacagcacgtttgtgctctgattcgtgtaactgatcagcagatcaaactctaccactgccgatatatatgtgaggaccatggattgatgcattgtcgttgatcttcatgttgtgtcttcatccgtttcatattataaaacgtttgactcttttcctagtcaaactttattaagtttatagaaaaatttaacatctaaaatatgaaattaatatcattaaatctaacattgaatatgttttcataatatgtttgttttgtgttgaaaacattgttatattttctataaatttgattaaatttaaagatgtttaactaagaaaataatcaaacgaacttataatatgaaacgagggagtattatatatctacggtctttgctagaattttgattttacacgtactggttctgttgaaaattactatatatttgcaaatcaacctggcgtgcatgtgtcaaccattcagatcatgcatggaactatgcaagacaggaggtactgtgatgaatatgtcccaaaattatatattcatatatatatgtgtacccactcacgaaaatttgttattcggtgttgcttttaaaacatatatgttattcgacaagttggcgtttcaaaattttaagcacaaatacaaggctaaaatgtagctttca

SEQ ID NO: 127 - DNA, 2444 bp, Oryza sativa
  misc_feature (1)..(2444): L37528 5'- regulatory sequence engineered
accacctcaatctccactgtttgattggacgtttaggtttcatatcaccaaggttcaatcagtgtggagtacttttcagtccttctggcctgtgccaaatgtagaaggagagccttttctctgatttgatccattcttgcaagctacaggtaagttgatttgattccacatagaattatttttcttctttgtttttccatgccttttcttctctgtcataaactcctaatttagctactataattttttcagtgaatcctagctaagagttagtttattgttctttttaggtactgaattttggtacatactagcaaattgtcatatacagcaacaaggatctagtggcatgagactttggcaagtgttcttgcagaaaccaaaatcagagctgcctccatttggctgaataattctggccatttctaaccgttcctcattgcttttctccttatgcatatactggaaaggtagctctgcaaaagtcaggtagacaataacactagaagcagttatatatgcttgcaaaaattcacaacctttccaaacaaaatttatttcttacaccattccaccaggaatggaatttcaatactaccttgccaagtgcagttacaaaatgttcaccaaaacgtccaaaccttcgctgcaactttaatttggacataattcatatatacttgctagtatagcaacaggaatgctgcatagtgacaacacatctaggatcatgtcccaactctgatagatccattacaccaacctatcttgagacagtgccaatgcaggaactaacctctcatggaaatgcatggtagctagctccacaatgtgacacatgtaagtctcaagttcaccgtgcgaaaaatcacgatgcgcgaatcgcccccccaatttcgacaggtaagggtagatcttcatcgatcggccagttgaaaacaacaacggcggtacaacgatcggccatcatcgtgcaccgcaccgcggcggtggcccagagccggtgatggggatgtatggacggtggagtgagtggagagagggttggcagcaagcatgatgcatcacattatgtgaggaagagataggggccccatgagagcaactgaaaggactgtgctgaattaataggaggctgctgctggtgagtacttagccattatctctgcatcctatgtgacaaacagaaactggacagtgtatgtggagtgtcacatggttgtatatacatcatacattaaatcatctctatgctgtatatatagatttgctttgtttttactctctgatgatctgatcggtagaataaagcaactagttatcagttattatatatcacacaaattaaataggaaagtaatttgatttgctgaattggaaactacagtaaaacttgttaggtgagttctgaaaaaaaaagtgcatctgctgaacttcattggcaaaacaatgtaaagcccttggcattaacatctgtaacattgtctcagatatatcagcttacaaggttcctgaactgtgaaaagtgaaacaaaaaggaggaaagcaataaccggtcttgctgttcccacaactgtttttttgtgtctaacatgcagtttaccagtccaaacaaagcaagtttcagacttacagcaacaagaagcaaagctttgcaagcagagttacatcagagttacttgcattacatattctgaggtaaaatggatatggagacatatgtatctgacagcacagcactgcctgccaggacaagagatcaaagagtaaagactgatggaaagagagctagctagtagtaaatcagaaaggttgtggattgcagtcagaagaaacaacaagctagagatagatagctatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatcttgaacatcttggtaaattctggctttcttgcttttggataaattttgcttcctttcttaacttgagcacaagcttgtgttatatgtggtgtggaatcttggttgccatgttgtgaggatttagctagagagtcaagaaagaggaatatatgctttatgtagataggagtaggatctctgggtctttaaacatcaccatgacaagcaaagataagaacaggagagcagttcttgattattatttttcttctcatcaagaaattaagccggagatagacatggcagctgcacgcagtgattcacttcttgatttcttgatttgggttgttgcgtttgtgtccagaccgatccaccatgg

SEQ ID NO: 128 - DNA, 1432 bp, Oryza sativa
  misc_feature (1)..(1432): L37528 3'-regulatory sequence engineered
  misc_feature (1)..(28): 3'-untranslated sequence
  misc_feature (29)..(426): Intron
  misc_feature (427)..(866): Exon
  misc_feature (867)..(1432): 3'-nontranscribed sequence
ttttggtgtagacaccgtacgtacacacgtacgttaggtaaataaaacactcagtactgtagatttatacctacacaaaagtatatatttgcagagtataatccagttaggcaagttgatatttaccctctgctatttttacataactgccagcggatactatttactttcgaactttggcaactcgtctttggaaatgataaaatgttattaaagtgtgctatatcttaaatacaagcatcggacttttgttcactttggtctaacaatttgagagaaaacaatgttcaatattcaaatggaaagtaaatgttgtcagttatttagaaacgaagggagtatatgtattactggcattcatcttaataattaactcagtaactgtttcttacatctcttgtagttgaaatctgaaagtgtgttgtatctgttgcagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatatatatatatatatatatatatatatatatatatatatatatatatatatatatatatataaacagcacgtttgtgctctgattcgtgtaactgatcagcagatcaaactctaccactgccgatatatatgtgaggaccatcgattgatgcattgtcgttgatcttcatgttgtgtcttcatccgtttcatattataaaacgtttgactcttttcctagtcaaactttattaagtttatagaaaaatttaacatctaaaatatgaaattaatatcattaaatctaacattgaatatgttttcataatatgtttgttttgtgttgaaaacattgttatattttctataaatttgattaaatttaaagatgtttaactaagaaaataatcaaacgaacttataatatgaaacgagggagtattatatatctacggtctttgctagaattttgattttacacgtactggttctgttgaaaattactatatatttgcaaatcaacctggcgtgcatgtgtcaaccattcagatcatgcatggaactatgcaagacaggaggtactgtgatgaatatgtcccaaaattatatattcatatatatatgtgtacccactcacgaaaatttgttattcggtgttgcttttaaaacatatatgttattcgacaagttggcgtttcaaaattttaagcacaaatacaaggctaaaatgtagctttca

SEQ ID NO: 129 - DNA, 3068 bp, Oryza sativa
  misc_feature (1)..(3068): U78891 5'-regulatory sequence
  misc_feature (1)..(1844): 5'-nontranscribed sequence
  misc_feature (1845)..(2126): Exon
  misc_feature (2127)..(3051): Intron
  misc_feature (2829)..(2829): y is c or t
  misc_feature (2851)..(2851): y is c or t
  misc_feature (3052)..(3068): Exon
tcttcttcttgccttcatttgagttaattacagcattgatttgtgtgaacaaaattcatcataaatcagttcctcgcgagatcattggtctcaacatgatggtgccaagtgagaactgcagtattgtgcagttttcagttttgagtctaagttgtataaacttgcagttggagtattatgctctagtattaatctactatcagacaaagataagatcactgattaattcacccctgacctgatccatcttgtgcacacgtcggccagcagcggaattgagcttctggatcagatcttaggcatcgtttggaacagagaagtttcaaagatttatgaagaatttgaattaaattcagtatagaatgcatgattgtgaaaagtacaataatatgaaaaataaaggattgagatatcatgatttaataatttattgaatactccatgtaacaaacccatagtaattgtccaaagtagatgttgggatagaaggaaaaatacagaaaacttatgattgtacggtgatttgatggagagaaaagggagagagaaagagacaacttgtagtgcaaccctaaaaggaatttgaatgaatatagttagaacttttgtggtagaaatttcttctaaaaatgtggagcaactttttcctatcctacaaaattccttcaaatcagtcctacataacctttccaaaatttcacaagaaatgaaataagcataccattccatcttgtgcacacgtcccccagtagcgaaattgagtttctaggtcagatcttgagcctcgctggaacggagaaattttaaagatttataaaggatttaaattaaatctagcatagaacgtatgaatattaaaagaaatatagaaataaggaaaacataggattgtgataccatgatttaataatttaatgagtccatgaaacaaacccatggtaattgcccaaaatagatgtttggatagcttagaaaaaaaatacagaaaattaagattttacggtgattagttggagagagaagggagagacataagttgcatcgcaattctcaaacgaagtcgaaaaatatgaggttagattttattctagaattcctctaaaatacggacgacgaaattactttgaatcaatccaacaaatctacataggaattactctttcggactcaaactcctcaattttttcccacttaaaaatccttcgccctaattaaagttcacccgttacaaatggagagcgatcgagctctcaactagcctaattcaagaggtgatgaagaaaaatggcagagaaaaagaagaagaagaagaagaagaagccgcaatcactcctagtccttacaaggttctgccgccgtggtgaggccaatggcacatactttcaggcttcagcccaccaaatggagacgccatacggcctatgctgttccaggcccaaattacaccggctaaaccccatacggcccatacatataccattcctggtccaaaaccggtgggttcccgagtagggaatcggacacggcccgactcaaacacacgcactctccaagtctcgagctccacgacgacgacgacgacgatgacgatggcgcacagggcaggggcaggcaggtcacatgtggtggtgaatggtgatggccatccatccatccaccaatgaaaaggcgagtcgtggtaaagaagacggatggacggatggatgggcatgggcggcgagcgatggacgcgacgcgacccatcctggtttcccgaaacgcgctacgctgccgagcatctagggtttcccacccggtacgaccttgccgaaaatggcacccactcaccatctcccatccttttaatccccttcctccacctcgcttgctttcttgcagtggtggtggtggtggtggtgagatctagcttggttggttggttgcagctggagatcgatcgggatggggaggggtcgggtggagctgaagaggatcgagaacaagatcaaccggcaggtgacgttcgccaagcgcaggaatggcctgctcaagaaggcgtacgagctctccgtcctctgcgacgccgaggtcgccctcatcatcttctccaaccgcggcaagctctacgagttctgcagcacccagaggttcatttcatttcctagctactctaatccatccatcaaacccacatcacatcacacttcaatttcgcaagcttaattagccaccctttcgattggatctgtcctgtccagatctgttcatgcatcatcaaaagctagctgcatctgccttttgcccggaattccagctgcatgctatgccggcttgatttctgcatacgatcttttgacaagaaacgagctgtggcgtgttcaaccgcacgctacctagctagctagattgctcttgcttccgtgggttttcacgccgggatagatctgggcaatatcctgggtttagggttttgcttcctggtccgtgtggtagatcggtgcacatctttagtttgccagttggtttccttctccgatctgtccgtcttacgtgcgatttcttcatgtgtggtctcggaactcgcaaaggaactgaaaagtttgcttatttacgaccttttcttctggatctgcaaggttctttgtttcccttagctaaatccttaaaagaagtagtccaatatatacttccatgcataatattgcaaaataaatgatggtttgttgataaccaaagtaaagagacataaaaactaactagagactttttttttcaaaaaaaaaaaggaagaatcttggtcaacggggttatatatcagtagtatatttccggggatcaagggcttcagtytactaatcaaacaatttaatcycatagggggacttgcaagaaccatatgttccatttctgaatgtattttaagctaaaatgcatgacaacgaaaaaagggcattgtggtagtaaatgtgccatgcccctattgtagatcttaatcatcgttaatctctccttcttgtgatcccatgcatgcactaattttaattaattcctcatgtcttttgaactttgtagcatgactaaaacgcttg

SEQ ID NO: 130 - DNA, 1059 bp, Oryza sativa
  misc_feature (1)..(1059): U78891 3'- regulatory sequence
  misc_feature (1)..(277): 3'-untranslated sequence
  misc_feature (278)..(1059): 3'-nontranscribed sequence
tgaacagtgcgtgcatgaacacctacatgcccccatggctaccatgatgatgacggggacaatgaattacgaaataacaaggatatgtggcatatatgtggtgccgcatacatgcatgtatcatggctagctacttaattggagtgatggatttgaactagtttcgtatgtagcctgtttgtgtgtaacttgtgtgagatactaccttaaaaactatcggtgtctgttgaacatattctgcgatcaactttaagcgtattattatcattttcattccattctgtttagttcacttgtacttgctaaatgccttaactttgctacagataaaaaaaatattactaacttgataaacacaaatatatttttctggaatatgctacttttttatagggaatattcaccttatttgattttatatgtggatatacatttacatttattttttaatattaaaaaattaagggatattttgtaaaaattttaacggggtaggtggcatgacagattcactgtcgcatccttccagcctagctatgtttttcttgtttcgtattaaagtttttttaaaaaatttctatcgcatcattaccatccttccagcgtactccctttatcgcataaaaaaacaacctagtaccggatgacacatcttgatcctattaatctggacatacatatgtatagatttatagtactaaaatatgtcacatatggttctagatttgttttttataggaccggagggagtagctatgtttttcacgtttcgtattaagttttttttaaaaaaaaaaatcttgagagtatctgagatgctatcacatagtagagtactactagtagaaacagtactgcatctgctgaaataaatagggaaaaggacacaaccaagagtgcgcagcccatgaccagttccggcccgtggaatccatgtatccagcgaattgggccgtatctgtgcgtggggcggcccatgaataaacttgtggataaatgtaggccatagttatcgtcgttttctccatggccttgcatcaaaagacaaaaaaaaacatc

SEQ ID NO: 131 - DNA, 3069 bp, Oryza sativa
  misc_feature (1)..(3069): U78891 5'-regulatory sequence engineered
  misc_feature (2829)..(2829): y is c or t
  misc_feature (2851)..(2851): y is c or t
tcttcttcttgccttcatttgagttaattacagcattgatttgtgtgaacaaaattcatcataaatcagttcctcgcgagatcattggtctcaacatgatggtgccaagtgagaactgcagtattgtgcagttttcagttttgagtctaagttgtataaacttgcagttggagtattatgctctagtattaatctactatcagacaaagataagatcactgattaattcacccctgacctgatccatcttgtgcacacgtcggccagcagcggaattgagcttctggatcagatcttaggcatcgtttggaacagagaagtttcaaagatttatgaagaatttgaattaaattcagtatagaatgcatgattgtgaaaagtacaataatatgaaaaataaaggattgagatatcatgatttaataatttattgaatactccatgtaacaaacccatagtaattgtccaaagtagatgttgggatagaaggaaaaatacagaaaacttatgattgtacggtgatttgatggagagaaaagggagagagaaagagacaacttgtagtgcaaccctaaaaggaatttgaatgaatatagttagaacttttgtggtagaaatttcttctaaaaatgtggagcaactttttcctatcctacaaaattccttcaaatcagtcctacataacctttccaaaatttcacaagaaatgaaataagcataccattccatcttgtgcacacgtcccccagtagcgaaattgagtttctaggtcagatcttgagcctcgctggaacggagaaattttaaagatttataaaggatttaaattaaatctagcatagaacgtatgaatattaaaagaaatatagaaataaggaaaacataggattgtgataccatgatttaataatttaatgagtccatgaaacaaaccgatggtaattgcccaaaatagatgtttggatagcttagaaaaaaaatacagaaaattaagattttacggtgattagttggagagagaagggagagacataagttgcatcgcaattctcaaacgaagtcgaaaaatatgaggttagattttattctagaattcctctaaaatacggacgacgaaattactttgaatcaatccaacaaatctacataggaattactctttcggactcaaactcctcaattttttcccacttaaaaatccttcgccctaattaaagttcacccgttacaaatggagagcgatcgagctctcaactagcctaattcaagaggtgatgaagaaaaatggcagagaaaaagaagaagaagaagaagaagaagccgcaatcactcctagtccttacaaggttctgccgccgtggtgaggccaatggcacatactttcaggcttcagcccaccaaatggagacgccatacggcctatgctgttccaggcccaaattacaccggctaaaccccatacggcccatacatataccattcctggtccaaaaccggtgggttcccgagtagggaatcggacacggcccgactcaaacacacgcactctccaagtctcgagctccacgacgacgacgacgacgatgacgatggcgcacagggcaggggcaggcaggtcacatgtggtggtgaatggtgatggccatccatccatccaccaatgaaaaggcgagtcgtggtaaagaagacggatggacggatggatgggcatgggcggcgagcgatggacgcgacgcgacccatcctggtttcccgaaacgcgctacgctgccgagcatctagggtttcccacccggtacgaccttgccgaaaatggcacccactcaccatctcccatccttttaatccccttcctccacctcgcttgctttcttgcagtggtggtggtggtggtggtgagatctagcttggttggttggttgcagctggagatcgatcgggatcgggaggggtcgggtggagctgaagaggatcgagaacaagatcaaccggcaggtgacgttcgccaagcgcaggaatggcctgctcaagaaggcgtacgagctctccgtcctctgcgacgccgaggtcgccctcatcatcttctccaaccgcggcaagctctacgagttctgcagcacccagaggttcatttcatttcctagctactctaatccatccatcaaacccacatcacatcacacttcaatttcgcaagcttaattagccaccctttcgattggatctgtcctgtccagatctgttcatgcatcatcaaaagctagctgcatctgccttttgcccggaattccagctgcatgctatgccggcttgatttctgcatacgatcttttgacaagaaacgagctgtggcgtgttcaaccgcacgctacctagctagctagattgctcttgcttccgtgggttttcacgccgggatagatctgggcaatatcctgggtttagggttttgcttcctggtccgtgtggtagatcggtgcacatctttagtttgccagttggtttccttctccgatctgtccgtcttacgtgcgatttcttcatgtgtggtctcggaactcgcaaaggaactgaaaagtttgcttatttacgaccttttcttctggatctgcaaggttctttgtttcccttagctaaatccttaaaagaagtagtccaatatatacttccatgcataatattgcaaaataaatgatggtttgttgataaccaaagtaaagagacataaaaactaactagagactttttttttcaaaaaaaaaaaggaagaatcttggtcaacggggttatatatcagtagtatatttccggggatcaagggcttcagtytactaatcaaacaatttaatcycatagggggacttgcaagaaccatatgttccatttctgaatgtattttaagctaaaatgcatgacaacgaaaaaagggcattgtggtagtaaatgtgccatgcccctattgtagatcttaatcatcgttaatctctccttcttgtgatcccatgcatgcactaattttaattaattcctcatgtcttttgaactttgtagcatcactaaccaccatgg

SEQ ID NO: 132 - DNA, 1055 bp, Oryza sativa
  misc_feature (1)..(1055): U78891 3'-regulatory sequence engineered
  misc_feature (1)..(274): 3'-untranslated sequence
  misc_feature (275)..(1055): 3'-nontranscribed sequence
acagtgcgtgcatgaacacctacatgcccgcatggctaccatgatgatgacggggacaatgaattacgaaataacaaggatatgtggcatatatgtggtgccgcatacatgcatgtatcatggctagctacttaattggagtgatggatttgaactagtttcgtatgtagcctgtttgtgtgtaacttgtgtgagatactaccttaaaaactatcggtgtctgttgaacatattctgcgatcaactttaagcgtattattatcattttcattccattctgtttagttcacttgtacttgctaaatgccttaactttgctacagataaaaaaaatattactaacttgataaacacaaatatatttttctggaatatgctacttttttatagggaatattcaccttatttgattttatatgtggatatacatttacatttattttttaatattaaaaaattaagggatattttgtaaaaattttaacggggtaggtggcatgacagattcactgtcgcatccttccagcctagctatgtttttcttgtttcgtattaaagtttttttaaaaaatttctatcgcatcattaccatccttccagcgtactccctttatcgcataaaaaaacaacctagtaccggatgacacatcttgatcctattaatctggacatacatatgtatagatttatagtactaaaatatgtcacatatggttctagatttgttttttataggaccggagggagtagctatgtttttcacgtttcgtattaagttttttttaaaaaaaaaaatcttgagagtatctgagatgctatcacatagtagagtactactagtagaaacagtactgcatctgctgaaataaatagggaaaaggacacaaccaagagtgcgcagcccatgaccagttccggcccgtggaatccatgtatccagcgaattgggccgtatctgtgcgtggggcggcccatgaataaacttgtggataaatgtaggccatagttatcgtcgttttctcgatggccttgcatcaaaagacaaaaaaaaacat

SEQ ID NO: 133 - DNA, 30 bp, Artificial sequence
  f primer
  misc_feature (1)..(30): AB003322-1
cgttgcccagcgaggagcatgcgtaaaatc

SEQ ID NO: 134 - DNA, 30 bp, Artificial sequence
  R primer
  misc_feature (1)..(30): AB003322-2
gatttcattcatactgtccaacagaaggca

SEQ ID NO: 135 - DNA, 30 bp, Artificial sequence
  F primer
  misc_feature (1)..(30): AB003322-3
taactgaaaggaaaaaaaaagcatccttgc

SEQ ID NO: 136 - DNA, 30 bp, Artificial sequence
  R primer
  misc_feature (1)..(30): AB003322-4
gaataaatctggcaactgaaatccaaccat

SEQ ID NO: 137 - DNA, 30 bp, Artificial sequence
  primer
  misc_feature (1)..(30): AB003322-5
cgcgcggcggcgatcgcgcgggagaggcgg

SEQ ID NO: 138 - DNA, 27 bp, Artificial sequence
  Primer
  misc_feature (1)..(27): AB003322-6
cttctgttggacagtatcaatgaaatc

SEQ ID NO: 139 - DNA, 26 bp, Artificial Sequence
  Primer
  misc_feature (1)..(26): AB003322-7
atttcatccatgctacaatttatttt

SEQ ID NO: 140 - DNA, 26 bp, Artificial sequence
  Primer
  misc_feature (1)..(26): AB003322-8
agaaggccgaggaggtctccgtgctc

SEQ ID NO: 141 - DNA, 31 bp, Artificial sequence
  F primer
  misc_feature (1)..(31): AB003322-9
taataagagctctgaaaggaaaaaaaaagca

SEQ ID NO: 142 - DNA, 38 bp, Artificial Sequence
  R primer
  misc_feature (1)..(38): AB002233-10
  misc_feature (1)..(38): AB003322-10 R primer
atatatgcggccgcggtccgaataaatctggcaactga

SEQ ID NO: 143 - DNA, 35 bp, Artificial sequence
  F primer
  misc_feature (1)..(35): AB003322-11
tatataccatggtggtgatactgtccaacagaagg

SEQ ID NO: 144 - DNA, 37 bp, Artificial sequence
  R primer
  misc_feature (1)..(37): AB003322-12
atatatggatccggaccgttgcccagcgaggagcatg

SEQ ID NO: 145 - DNA, 24 bp, Artificial sequence
  F primer
  misc_feature (1)..(24): AB003324-1
tctaaatagggcccaacatactca

SEQ ID NO: 146 - DNA, 29 bp, Artificial sequence
  R primer
  misc_feature (1)..(29): AB003324 R primer
tcaagcgtcttaagcatgctgaaatatga

SEQ ID NO: 147 - DNA, 28 bp, Artificial sequence
  F primer
  misc_feature (1)..(28): AB003324-3 F primer
ctagctagctagctaccgtttcagcttc

SEQ ID NO: 148 - DNA, 26 bp, Artificial Sequence
  R primer
  misc_feature (1)..(26): AB003324-4 R primer
tggagatcgaccacaattaaattcgt

SEQ ID NO: 149 - DNA, 30 bp, Artificial sequence
  Primer
  misc_feature (1)..(30): AB003324-5
tcgagcgggagatcgagatcgggcgaggca

SEQ ID NO: 150 - DNA, 26 bp, Artificial Sequence
  Primer
  misc_feature (1)..(26): AB003324-6
aattcatatttcagcatccttaagac

SEQ ID NO: 151 - DNA, 27 bp, Artificial sequence
  Primer
  misc_feature (1)..(27): AB003324-7
actgtgcagatgaggtcatgcgctcat

SEQ ID NO: 152 - DNA, 28 bp, Artificial Sequence
  Primer
  misc_feature (1)..(28): AB003324-8
aggcctacgagctgtccatcctctgcga

SEQ ID NO: 153 - DNA, 28 bp, Artificial sequence
  Primer
  misc_feature (1)..(28): AB003324-9
acgcgtccggccatcgctgcctagctag

SEQ ID NO: 154 - DNA, 44 bp, Artificial sequence
  F primer
  misc_feature (1)..(44): AB003324-10
atatatgcggccgcggtccgtggagatcgaccacaattaaattc

SEQ ID NO: 155 - DNA, 35 bp, Artificial sequence
  R primer
  misc_feature (1)..(35): AB003324-11
taggtagagctcctagctagctagctaccgtttca

SEQ ID NO: 156 - DNA, 39 bp, Artificial sequence
  F primer
  misc_feature (1)..(39): AB003324-12
atatatggatccggaccgtctaaatagggcccaacatac

SEQ ID NO: 157 - DNA, 36 bp, Artificial sequence
  R primer
  misc_feature (1)..(36): AB003324-13
tatataccatggtggcttaaggatgctgaaatatga

SEQ ID NO: 158 - DNA, 26 bp, Artificial sequence
  F primer
  misc_feature (1)..(26): AB003328-1
aacaaaaccaataatctccaatgccc

SEQ ID NO: 159 - DNA, 26 bp, Artificial sequence
  R primer
  misc_feature (1)..(26): AB003328-2
catcttcgatcgccgatgaaccaacc

SEQ ID NO: 160 - DNA, 26 bp, Artificial sequence
  F primer
  misc_feature (1)..(26): AB003328-3
taagtaacaggccaggaataagctgg

SEQ ID NO: 161 - DNA, 26 bp, Artificial sequence
  R primer
  misc_feature (1)..(26): AB003328-4
attgccgggctatagcctttctccct

SEQ ID NO: 162 - DNA, 30 bp, Artificial sequence
  Primer
  misc_feature (1)..(30): AB003328-5
cgtattgtcgtccatgcatgcgaaatgcta

SEQ ID NO: 163 - DNA, 33 bp, Artificial sequence
  F primer
  misc_feature (1)..(33): AB003328-6
taataagagctcgtaacaggccaggaataagct

SEQ ID NO: 164 - DNA, 39 bp, Artificial sequence
  Primer
  misc_feature (1)..(39): AB003328-7
atatatgcggccgcggtccgattgccgggctatagcctt

SEQ ID NO: 165 - DNA, 41 bp, Artificial sequence
  F primer
  misc_feature (1)..(41): AB003328-8
tatataggatccggaccgaacaaaaccaataatctccaatg

SEQ ID NO: 166 - DNA, 36 bp, Artificial sequence
  R primer
  misc_feature (1)..(36): AB003328-9
tatataccatggtggatcgccgatgaaccaaccaac

SEQ ID NO: 167 - DNA, 26 bp, Artificial sequence
  F primer
  misc_feature (1)..(26): AB077760-1
attcgttgggggtgacatgactagtc

SEQ ID NO: 168 - DNA, 26 bp, Artificial sequence
  R primer
  misc_feature (1)..(26): AB077760-2
caaagatccccttgatgctgcagcag

SEQ ID NO: 169 - DNA, 25 bp, Artificial sequence
  F primer
  misc_feature (1)..(25): AB077760-3
tgatatatcatcgccgccgccgccg

SEQ ID NO: 170 - DNA, 29 bp, Artificial sequence
  R primer
  misc_feature (1)..(29): AB077760-4
ccgtggtactgaaatcgaaaaaagaaatg

SEQ ID NO: 171 - DNA, 36 bp, Artificial sequence
  Primer
  misc_feature (1)..(36): AB077760-5
gctgcagggggcggccatcgggaggggcaagatcga

SEQ ID NO: 172 - DNA, 26 bp, Artificial sequence
  Primer
  misc_feature (1)..(26): AB077760-6
cgcacggggatcatcaagaaggccag

SEQ ID NO: 173 - DNA, 25 bp, Artificial sequence
  Primer
  misc_feature (1)..(25): AB077760-7
tcgccatcatcatcttctcctccac

SEQ ID NO: 174 - DNA, 31 bp, Artificial sequence
  Primer
  misc_feature (1)..(31): AB077760-8
atgaagaaggccagggtgctcaccgtgctct

SEQ ID NO: 175 - DNA, 26 bp, Artificial sequence
  F primer
  misc_feature (1)..(26): AB077760-11
atgcatgagctctatatcatcgccgc

SEQ ID NO: 176 - DNA, 33 bp, Artificial sequence
  R primer
  misc_feature (1)..(33): AB077760-12
atatatgcggccgcggtccgtggtactgaaatc

SEQ ID NO: 177 - DNA, 39 bp, Artificial sequence
  F primer
  misc_feature (1)..(39): AB077760-9
atatatgtcgacggaccgattcgttgggggtgacatgac

SEQ ID NO: 178 - DNA, 37 bp, Artificial sequence
  R primer
  misc_feature (1)..(37): AB077760-10
tacagtaccatggtggcccttgatgctgcagcaggat

SEQ ID NO: 179 - DNA, 25 bp, Artificial sequence
  F primer
  misc_feature (1)..(25): AB095645-1
ctcgtcgccgtcgttggctcggcgt

SEQ ID NO: 180 - DNA, 26 bp, Artificial sequence
  R primer
  misc_feature (1)..(26): AB095645-2
caagattcttgatagccttatacatg

SEQ ID NO: 181 - DNA, 25 bp, Artificial sequence
  F primer
  misc_feature (1)..(25): AB095645-3
taagctgctaggttgccccgccact

SEQ ID NO: 182 - DNA, 26 bp, Artificial sequence
  R primer
  misc_feature (1)..(26): AB095645-4
gcacggctacctctcgccggagtacg

SEQ ID NO: 183 - DNA, 25 bp, Artificial sequence
  Primer
  misc_feature (1)..(25): AB095645-5
aggaggcgggatcgggcgcgggaag

SEQ ID NO: 184 - DNA, 29 bp, Artificial sequence
  Primer
  misc_feature (1)..(29): AB956645-6
gaaacgtgggccatcgccattgagcgaaa

SEQ ID NO: 185 - DNA, 27 bp, Artificial sequence
  Primer
  misc_feature (1)..(27): AB095645-7
ttcctcttcctcccatcgcgaactcct

SEQ ID NO: 186 - DNA, 26 bp, Artificial sequence
  Primer
  misc_feature (1)..(26): AB0956645-8
tgccgtttctggagctgccctactga

SEQ ID NO: 187 - DNA, 29 bp, Artificial sequence
  Primer
  misc_feature (1)..(29): AB095645-9
gtaaaattgcagatcgatggatgtctcca

SEQ ID NO: 188 - DNA, 25 bp, Artificial sequence
  Primer
  misc_feature (1)..(25): AB095645-10
gaacctctccatgccgtgcaccccg

SEQ ID NO: 189 - DNA, 34 bp, Artificial sequence
  F primer
  misc_feature (1)..(34): AB095645-13
taataagagctcgctgctaggttgccccgccact

SEQ ID NO: 190 - DNA, 40 bp, Artificial sequence
  R primer
  misc_feature (1)..(40): AB095645-14
taataagcggccgcggtccgcacggctacctctcgccgga

SEQ ID NO: 191 - DNA, 46 bp, Artificial sequence
  F primer
  misc_feature (1)..(46): AB095645-11
gagagacctgcaggcggaccgctcgtcgccgtcgttggctcggcgt

SEQ ID NO: 192 - DNA, 37 bp, Artificial sequence
  R primer
  misc_feature (1)..(37): AB095645-12
atatatccatggtggttgatagccttatacatgtccc

SEQ ID NO: 193 - DNA, 28 bp, Artificial sequence
  F primer
  misc_feature (1)..(28): AF139664-1
tgcatccttacaaagagacagatagatc

SEQ ID NO: 194 - DNA, 29 bp, Artificial sequence
  R primer
  misc_feature (1)..(29): AF139664-2
caaggattttgtccatactgtgaaaaatg

SEQ ID NO: 195 - DNA, 25 bp, Artificial sequence
  F primer
  misc_feature (1)..(25): AF139664-3
taaggaggcttcagatccataccag

SEQ ID NO: 196 - DNA, 26 bp, Artificial sequence
  R primer
ggataaacattgtgaagcaacatttc

SEQ ID NO: 197 - DNA, 28 bp, Artificial sequence
  Primer
  misc_feature (1)..(28): AF139664-5
agaacaggaggaagaaggggcggggcaa

SEQ ID NO: 198 - DNA, 29 bp, Artificial sequence
  Primer
  misc_feature (1)..(29): AF139664-6
tacgccaccgactcaaggtacgtacgtac

SEQ ID NO: 199 - DNA, 28 bp, Artificial sequence
  Primer
  misc_feature (1)..(28): AF139664-7
tcatttttcacagtatcgacaaaatcct

SEQ ID NO: 200 - DNA, 29 bp, Artificial sequence
  Primer
  misc_feature (1)..(29): AF139664-8
tgggcaggaaaaggcatggcccaccccca

SEQ ID NO: 201 - DNA, 28 bp, Artificial sequence
  Primer
  misc_feature (1)..(28): AF139664-9
tgctttgattaatacagctcgcagcgac

SEQ ID NO: 202 - DNA, 28 bp, Artificial sequence
  Primer
  misc_feature (1)..(28): AF139664-10
acctgacccggtcccgtcgcctgctgct

SEQ ID NO: 203 - DNA, 33 bp, Artificial sequence
  Primer
  misc_feature (1)..(33): AF139664-11
taataagagctcggaggcttcagatccatacca

SEQ ID NO: 204 - DNA, 40 bp, Artificial sequence
  Primer
  misc_feature (1)..(40): AF139664-12
atatatgcggccgcggtccggataaacattgtgaagcaac

SEQ ID NO: 205 - DNA, 38 bp, Artificial sequence
  Primer
  misc_feature (1)..(38): AF139664-13
atatatggatccggaccgtgcatccttacaaagagaca

SEQ ID NO: 206 - DNA, 36 bp, Artificial sequence
  Primer
  misc_feature (1)..(36): AF139664-14
tatataccatggtggttgtccatactgtgaaaaatg

SEQ ID NO: 207 - DNA, 25 bp, Artificial sequence
  F primer
  misc_feature (1)..(25): AF139665-1
acctggggtttggaaatggggagcg

SEQ ID NO: 208 - DNA, 29 bp, Artificial sequence
  R primer
  misc_feature (1)..(29): AF139665-2
caaggatcccttccatactacagaagaag

SEQ ID NO: 209 - DNA, 27 bp, Artificial sequence
  F primer
  misc_feature (1)..(27): AF139665-3
tgaaggcatctgttgatctcaaacgtc

SEQ ID NO: 210 - DNA, 27 bp, Artificial sequence
  R primer
  misc_feature (1)..(27): AF139665-4
atgaactccacctcgggaactcagcct

SEQ ID NO: 211 - DNA, 29 bp, Artificial sequence
  Primer
  misc_feature (1)..(29): AF139665-5
ccgccgacgacgatcgggagagggccggt

SEQ ID NO: 212 - DNA, 27 bp, Artificial sequence
  Primer
  misc_feature (1)..(27): AF139665-6
tcttctgtagtatcgaagggatccttg

SEQ ID NO: 213 - DNA, 27 bp, Artificial sequence
  Primer
  misc_feature (1)..(27): AF139665-7
tcgccgcgcgcgcgcgatgggcgagct

SEQ ID NO: 214 - DNA, 32 bp, Artificial sequence
  Primer
  misc_feature (1)..(32): AF139665-8
tgatgagcggccgcaggcatctgttgatctca

SEQ ID NO: 215 - DNA, 40 bp, Artificial sequence
  Primer
  misc_feature (1)..(40): AF139665-9
tatataactagtgcggtccgatgaactccacctcgggaac

SEQ ID NO: 216 - DNA, 36 bp, Artificial sequence
  Primer
  misc_feature (1)..(36): AF139665-10
atatatgtcgacggaccgacctggggtttggaaatg

SEQ ID NO: 217 - DNA, 33 bp, Artificial sequence
  Primer
  misc_feature (1)..(33): AF139665-11
tatataccatggtggccttccatactacagaag

SEQ ID NO: 218 - DNA, 37 bp, Artificial sequence
  F primer
  misc_feature (1)..(37): AF141964-1
aaaacactgattaaagggttgttgaaaggaaaacacc

SEQ ID NO: 219 - DNA, 37 bp, Artificial sequence
  Primer
  misc_feature (1)..(29): AF141964-2
cataggtaccttcaatgctgaaaaagaaaacaaggca

SEQ ID NO: 220 - DNA, 25 bp, Artificial sequence
  F Primer
  misc_feature (1)..(25): AF141964-3
tgagcaggaagcacaggtgtcctgt

SEQ ID NO: 221 - DNA, 26 bp, Artificial sequence
  Primer
  misc_feature (1)..(26): AF141965-4
atgagatacaatctagtacaacgaat

SEQ ID NO: 222 - DNA, 34 bp, Artificial sequence
  Primer
  misc_feature (1)..(34): AF141964-5
gggtttttcggggcggggaaggcgcggaggggga

SEQ ID NO: 223 - DNA, 30 bp, Artificial sequence
  Primer
  misc_feature (1)..(30): AF141964-6
tgaagttgtccatgcttactaatactcaaa

SEQ ID NO: 224 - DNA, 31 bp, Artificial sequence
  Primer
  misc_feature (1)..(31): AF141964-7
attggttttcccatgcgtgtgatggatattc

SEQ ID NO: 225 - DNA, 40 bp, Artificial sequence
  Primer
  misc_feature (1)..(40): AF141964-8
gaccaaaaccagcccatgctgcatggtacactattaggct

SEQ ID NO: 226 - DNA, 33 bp, Artificial sequence
  Primer
  misc_feature (1)..(33): AF141964-9
cctaataagaaaccgatgggtataaaatggaga

SEQ ID NO: 227 - DNA, 33 bp, Artificial sequence
  Primer
  misc_feature (1)..(33): AF141964-10
agagaaaagagttgccttggcctctggctctgc

SEQ ID NO: 228 - DNA, 29 bp, Artificial sequence
  Primer
  misc_feature (1)..(29): AF141964-11
tgatgagcggccgcaggaagcacaggtgt

SEQ ID NO: 229 - DNA, 38 bp, Artificial sequence
  Primer
  misc_feature (1)..(38): AF141964-12
atatatcccgggcggtccgatgagatacaatctagtac

SEQ ID NO: 230 - DNA, 40 bp, Artificial sequence
  Primer
  misc_feature (1)..(40): AF141964-13
atatatcctgcaggcggaccgaaaacactgattaaagggt

SEQ ID NO: 231 - DNA, 38 bp, Artificial sequence
  Primer
  misc_feature (1)..(38): AF141964-14
atatatccatggtggccttcaatgctgaaaaagaaaac

SEQ ID NO: 232 - DNA, 27 bp, Artificial sequence
  Primer
  misc_feature (1)..(27): AF141965-1
tgtttctcgattaggctacaagttaac

SEQ ID NO: 233 - DNA, 27 bp, Artificial sequence
  R primer
  misc_feature (1)..(27): AF141965-2
gatggttttctgtaggctgcagaacag

SEQ ID NO: 234 - DNA, 28 bp, Artificial sequence
  F primer
  misc_feature (1)..(28): AF141965-3
tgaagaaggccagccacagcaacagctg

SEQ ID NO: 235 - DNA, 26 bp, Artificial sequence
  R primer
  misc_feature (1)..(26): AF141965-4
ccttatcgaatattcaaatctcgatg

SEQ ID NO: 236 - DNA, 28 bp, Artificial sequence
  Primer
  misc_feature (1)..(28): AF141965-5
gagagatcgggatcgatcgtgcggggga

SEQ ID NO: 237 - DNA, 29 bp, Artificial sequence
  Primer
  misc_feature (1)..(29): AF141965-6
tccaagcgccggaaaggcctcctcaagaa

SEQ ID NO: 238 - DNA, 29 bp, Artificial sequence
  Primer
  misc_feature (1)..(29): AF141965-7
gaaaatggaggatgcagaatatatatcct

SEQ ID NO: 239 - DNA, 27 bp, Artificial sequence
  Primer
  misc_feature (1)..(27): AF141965-8
aacaactgttccaaggagcatgtccac

SEQ ID NO: 240 - DNA, 26 bp, Artificial sequence
  misc_feature (1)..(26): AF141965-9
cttctcgcgcgcccgcgatttccgtt

SEQ ID NO: 241 - DNA, 25 bp, Artificial sequence
  Primer
  misc_feature (1)..(25): AF141965-10
tctccccccgcggcggcctctacga

SEQ ID NO: 242 - DNA, 29 bp, Artificial sequence
  Primer
  misc_feature (1)..(29): AF141965-11
tgatgagcggccgcagaaggccagccaca

SEQ ID NO: 243 - DNA, 35 bp, Artificial sequence
  Primer
  misc_feature (1)..(35): AF141965-12
tatatacccgggcggtccgccttatcgaatattca

SEQ ID NO: 244 - DNA, 37 bp, Artificial sequence
  Primer
  misc_feature (1)..(37): AF141965-13
atatatggatccggaccgtgtttctcgattaggctac

SEQ ID NO: 245 - DNA, 38 bp, Artificial sequence
  Primer
  misc_feature (1)..(38): AF141965-14
atatatccatggtggtctgtaggctgcagaacagacac

SEQ ID NO: 246 - DNA, 25 bp, Artificial sequence
  F primer
  misc_feature (1)..(25): AF174093-1
aaaattcacaagtataattcgtcac

SEQ ID NO: 247 - DNA, 25 bp, Artificial sequence
  Primer
  misc_feature (1)..(25): AF174093-2
cagctccatcaagcttaacaaagca

SEQ ID NO: 248 - DNA, 24 bp, Artificial sequence
  Primer
  misc_feature (1)..(24): AF174093-3
tgacttcctggaagcagtaggaac

SEQ ID NO: 249 - DNA, 25 bp, Artificial sequence
  R primer
  misc_feature (1)..(25): AF174093-4
ccccttctcctcctccgggaagaag

SEQ ID NO: 250 - DNA, 26 bp, Artificial sequence
  Primer
  misc_feature (1)..(26): AF174093-5
ggcgaggtcgcgttggggcaagggaa

SEQ ID NO: 251 - DNA, 28 bp, Artificial sequence
  Primer
  misc_feature (1)..(28): AF174093-6
gaagatcgagatcaagaggatcgaggac

SEQ ID NO: 252 - DNA, 25 bp, Artificial sequence
  Primer
  misc_feature (1)..(25): AF174093-7
cgtgctgtgcgaagcgcaggtcggc

SEQ ID NO: 253 - DNA, 25 bp, Artificial sequence
  Primer
  misc_feature (1)..(25): AF174093-8
aagaaggcgaaccagctcgccgtgc

SEQ ID NO: 254 - DNA, 29 bp, Artificial sequence
  F primer
  misc_feature (1)..(29): AF174093-10
tgatgagagctccttcctggaagcagtag

SEQ ID NO: 255 - DNA, 40 bp, Artificial sequence
  R primer
  misc_feature (1)..(40): AF174093-11
atatatgcggccgcggtccgccccttctcctcctccggga

SEQ ID NO: 256 - DNA, 40 bp, Artificial sequence
  misc_feature (1)..(40): AF174093-12
tatatcctgcaggcggaccgaaaattcacaagtataattc

SEQ ID NO: 257 - DNA, 33 bp, Artificial sequence
  R primer
  misc_feature (1)..(33): AF174093-13
tatataccatggtggtcaagcttaacaaagcat

SEQ ID NO: 258 - DNA, 30 bp, Artificial sequence
  Primer
  misc_feature (1)..(30): AF204063-1
acaaatttgttgtaccacctacctaggggt

SEQ ID NO: 259 - DNA, 27 bp, Artificial sequence
  R primer
  misc_feature (1)..(27): AF204063-2
caaggttttgtacatgctggaagtgaa

SEQ ID NO: 260 - DNA, 25 bp, Artificial sequence
  F primer
  misc_feature (1)..(25): AF204063-3
tgatgtgtgtgttcagttcaggctt

SEQ ID NO: 261 - DNA, 29 bp, Artificial sequence
  R primer
  misc_feature (1)..(29): AF204063-4
ctgcatatacttgcaacattgcaatttta

SEQ ID NO: 262 - DNA, 29 bp, Artificial sequence
  Primer
  misc_feature (1)..(29): AF204063-5
aggaggaggaagaagatcgggagggggaa

SEQ ID NO: 263 - DNA, 28 bp, Artificial sequence
  Primer
  misc_feature (1)..(28): AF204063-6
tctccagctcatcttggtacgtatagca

SEQ ID NO: 264 - DNA, 27 bp, Artificial sequence
  Primer
  misc_feature (1)..(27): AF204063-7
ttcacttccagcatctacaaaaccttg

SEQ ID NO: 265 - DNA, 26 bp, Artificial sequence
  Primer
  misc_feature (1)..(26): AF204063-8
atcttctccggccgccgccgcctctt

SEQ ID NO: 266 - DNA, 28 bp, Artificial sequence
  Primer
  misc_feature (1)..(28): AF204063-9
gtccagctagccaaggatggatatatta

SEQ ID NO: 267 - DNA, 37 bp, Artificial sequence
  F primer
  misc_feature (1)..(27): AF204063-10
tatatacccgggcggtccgctgcatatacttgcaaca

SEQ ID NO: 268 - DNA, 32 bp, Artificial sequence
  R primer
  misc_feature (1)..(32): AF204063-11
tgatgagcggccgctgtgtgtgttcagttcag

SEQ ID NO: 269 - DNA, 36 bp, Artificial sequence
  Primer
  misc_feature (1)..(36): AF204063-12
tatataggatccggaccgacaaatttgttgtaccac

SEQ ID NO: 270 - DNA, 33 bp, Artificial sequence
  R primer
  misc_feature (1)..(33): AF204063-13
atatatccatggtggtgtacatgctggaagtga

SEQ ID NO: 271 - DNA, 26 bp, Artificial sequence
  F primer
  misc_feature (1)..(26): AF345911-1
gaaaatctcaaggtttcgaaaacgac

SEQ ID NO: 272 - DNA, 30 bp, Artificial sequence
  R primer
  misc_feature (1)..(30): AF345911-2
caaggattttgtccatcctgcagggaaaac

SEQ ID NO: 273 - DNA, 26 bp, Artificial sequence
  F primer
  misc_feature: AF345911-3
taagatgatcatcgtcgtcgtcgtcg

SEQ ID NO: 274 - DNA, 32 bp, Artificial sequence
  R primer
  misc_feature (1)..(32): AF345911-4
ttgacttaaatggcaagataaattagatatag

SEQ ID NO: 275 - DNA, 27 bp, Artificial sequence
  Primer
  misc_feature (1)..(27): AF345911-5
agcggcgaggatcgggcgggggaaggt

SEQ ID NO: 276 - DNA, 28 bp, Artificial sequence
  Primer
  misc_feature (1)..(28): AF345911-6
gttttccctgcaggatcgacaaaatcct

SEQ ID NO: 277 - DNA, 27 bp, Artificial sequence
  Primer
  misc_feature (1)..(27): AF345911-7
cggccgcttccatcgatttcagctgct

SEQ ID NO: 278 - DNA, 28 bp, Artificial sequence
  Primer
  misc_feature (1)..(28): AF345911-8
agaactattccaaggtaattgtaccatc

SEQ ID NO: 279 - DNA, 32 bp, Artificial sequence
  Primer
  misc_feature (1)..(32): AF345911-9
taataagcggccgcgatgatcatcgtcgtcgt

SEQ ID NO: 280 - DNA, 36 bp, Artificial sequence
  Primer
  misc_feature (1)..(36): AF345911-10
tatatacccgggcggtccgttgacttaaatggcaag

SEQ ID NO: 281 - DNA, 34 bp, Artificial sequence
  Primer
  misc_feature (1)..(34): AF345911-11
tatatagtcgacggaccgaaaatctcaaggtttc

SEQ ID NO: 282 - DNA, 34 bp, Artificial sequence
  Primer
  misc_feature (1)..(34): AF345911-12
tatataccatggtggttgtcgatcctgcagggaa

SEQ ID NO: 283 - DNA, 27 bp, Artificial sequence
  F primer
  misc_feature (1)..(27): AF424549-1
tacaaagtgctggaagtgatagtatgt

SEQ ID NO: 284 - DNA, 28 bp, Artificial sequence
  R primer
  misc_feature (1)..(28): AF424549-2
gatccccttgatgctgcagcaggatgca

SEQ ID NO: 285 - DNA, 28 bp, Artificial sequence
  F primer
  misc_feature (1)..(28): AF424549-3
tgagatatcatcgccgccgccgccgccg

SEQ ID NO: 286 - DNA, 33 bp, Artificial sequence
  R primer
  misc_feature (1)..(33): AF424549-4
ttttattatcttggcgaggcccaagcacctttg

SEQ ID NO: 287 - DNA, 28 bp, Artificial sequence
  Primer
  misc_feature (1)..(28): AF424549-5
agggggcggcgatggggaggggcaagat

SEQ ID NO: 288 - DNA, 27 bp, Artificial sequence
  Primer
  misc_feature (1)..(27): AF424549-6
ccgcacggggatcatcaagaaggccag

SEQ ID NO: 289 - DNA, 27 bp, Artificial sequence
  Primer
  misc_feature (1)..(27): AF424549-7
aggtcgccatcatcaagttctcctcca

SEQ ID NO: 290 - DNA, 28 bp, Artificial sequence
  Primer
  misc_feature (1)..(28): AF424549-8
ttgcatctatccatcgttaaaacaagtc

SEQ ID NO: 291 - DNA, 30 bp, Artificial sequence
  Primer
  misc_feature (1)..(30): AF424549-9
tgatgagcggccgcgatatcatcgccgccg

SEQ ID NO: 292 - DNA, 36 bp, Artificial sequence
  Primer
  misc_feature (1)..(36): AF424549-10
tatatacccgggcggtccgttttattatcttggcga

SEQ ID NO: 293 - DNA, 35 bp, Artificial sequence
  Primer
  misc_feature (1)..(35): AF424549-11
tatatagtcgacggaccgtacaaagtgctggaagt

SEQ ID NO: 294 - DNA, 35 bp, Artificial sequence
  Primer
  misc_feature (1)..(35): AF424549-12
tatataccatggtggtgatgctgcagcaggatgca

SEQ ID NO: 295 - DNA, 29 bp, Artificial sequence
  F primer
  misc_feature (1)..(29): AJ293816-1
caaacattttaaactttaaccattaatag

SEQ ID NO: 296 - DNA, 28 bp, Artificial sequence
  R primer
  misc_feature (1)..(28): AJ293816-2
caataatctgttccatgcttcatcaatg

SEQ ID NO: 297 - DNA, 28 bp, Artificial sequence
  F primer
  misc_feature (1)..(28): AJ293816-3
tgatggctggaaactaaaactgagagga

SEQ ID NO: 298 - DNA, 28 bp, Artificial sequence
  R primer
  misc_feature (1)..(28): AJ293816-4
tttgaaacatttcggccctggctctcct

SEQ ID NO: 299 - DNA, 31 bp, Artificial sequence
  Primer
  misc_feature (1)..(31): AJ293816-5
tgtgtgatctgataaggctggcggcggcggt

SEQ ID NO: 300 - DNA, 30 bp, Artificial sequence
  Primer
  misc_feature (1)..(30): AJ293816-6
tacattgatgaagcatcgaacagattattg

SEQ ID NO: 301 - DNA, 32 bp, Artificial sequence
  Primer
  misc_feature (1)..(32): AJ293816-7
tgatgagcggccgctggctggaaactaaaact

SEQ ID NO: 302 - DNA, 38 bp, Artificial sequence
  Primer
  misc_feature (1)..(38): AJ293816-8
tatatacccgggcggtccgtttgaaacatttcggccct

SEQ ID NO: 303 - DNA, 38 bp, Artificial sequence
  Primer
  misc_feature (1)..(38): AJ293816-9
tatatagtcgacggaccgcaaacattttaaactttaac

SEQ ID NO: 304 - DNA, 36 bp, Artificial sequence
  Primer
  misc_feature (1)..(36): AJ293816-10
tatataccatggtggtgttcgatgcttcatcaatgt

SEQ ID NO: 305 - DNA, 27 bp, Artificial sequence
  F primer
  misc_feature (1)..(27): AY115556-1
gatataaaaacctactttatgttcatg

SEQ ID NO: 306 - DNA, 31 bp, Artificial sequence
  R primer
  misc_feature (1)..(31): AY115556-2
cagctcctccatggttctgttcaaagaaatc

SEQ ID NO: 307 - DNA, 27 bp, Artificial sequence
  F primer
  misc_feature (1)..(27): AY115556-3
taacactaataatggcctgggggatac

SEQ ID NO: 308 - DNA, 27 bp, Artificial sequence
  R primer
  misc_feature (1)..(27): AY115556-4
aactttgcacgaatgattaaattgcat

SEQ ID NO: 309 - DNA, 28 bp, Artificial sequence
  Primer
  misc_feature (1)..(28): AY115556-5
cttatcttgatcgatcgcgcgaggcaag

SEQ ID NO: 310 - DNA, 23 bp, Artificial sequence
  Primer
  misc_feature (1)..(23): AY115556-6
tgaacagaaccatcgaggagctg

SEQ ID NO: 311 - DNA, 28 bp, Artificial sequence
  misc_feature (1)..(28): AY115556-7
agctctgatatagcatggaggttaattg

SEQ ID NO: 312 - DNA, 30 bp, Artificial sequence
  Primer
  misc_feature (1)..(30): AY115556-8
taataagcggccgcactaataatggcctgg

SEQ ID NO: 313 - DNA, 34 bp, Artificial sequence
  Primer
  misc_feature (1)..(34): AY115556-9
tatatacccgggcggtccgaactttgcacgaatg

SEQ ID NO: 314 - DNA, 41 bp, Artificial sequence
  Primer
  misc_feature (1)..(41): AY115556-10
tatatacctgcaggcggaccgatataaaaacctactttatg

SEQ ID NO: 315 - DNA, 38 bp, Artificial sequence
  Primer
  misc_feature (1)..(38): AY115556-11
atatatccatggtggcgatggttctgttcaaagaaatc

SEQ ID NO: 316 - DNA, 27 bp, Artificial sequence
  F primer
  misc_feature (1)..(27): AY177695-1
tcagtccatcatttcgtctacaactaa

SEQ ID NO: 317 - DNA, 27 bp, Artificial sequence
  R primer
  misc_feature (1)..(27): AY177695-2
tattattgatttcatgctaacaaaaag

SEQ ID NO: 318 - DNA, 27 bp, Artificial sequence
  F primer
  misc_feature (1)..(27): AY177695-3
taacacatgatcaagtgttaaaaacag

SEQ ID NO: 319 - DNA, 27 bp, Artificial sequence
  R primer
  misc_feature (1)..(27): AY177695-4
ggctcggtcaaaccagcgtggtgagct

SEQ ID NO: 320 - DNA, 27 bp, Artificial sequence
  Primer
  misc_feature (1)..(27): AY177695-5
tcgatcgattgaagaaggggagaggga

SEQ ID NO: 321 - DNA, 26 bp, Artificial sequence
  Primer
  misc_feature (1)..(26): AY177695-6
gacaacacgaagaaccggcaggtgac

SEQ ID NO: 322 - DNA, 30 bp, Artificial sequence
  Primer
  misc_feature (1)..(30): AY177695-7
cgcggcgggctgatcaagaaggcccgggag

SEQ ID NO: 323 - DNA, 27 bp, Artificial sequence
  Primer
  misc_feature (1)..(27): AY177695-8
ctttttgttagcatcaaatcaataata

SEQ ID NO: 324 - DNA, 31 bp, Artificial sequence
  Primer
  misc_feature (1)..(31): AY177695-9
tgaagagcaaaccatcgagctaacaaacaca

SEQ ID NO: 325 - DNA, 34 bp, Artificial sequence
  Primer
  misc_feature (1)..(34): AY177695-10
tcagggatgacaacacgatggcaccatcagtcat

SEQ ID NO: 326 - DNA, 34 bp, Artificial sequence
  Primer
  misc_feature (1)..(11): AY177695-11
taataagagctccacatgatcaagtgttaaaaac

SEQ ID NO: 327 - DNA, 38 bp, Artificial sequence
  Primer
  misc_feature (1)..(38): AY177695-12
tatatagcggccgcggtccggctcggtcaaaccagcgt

SEQ ID NO: 328 - DNA, 36 bp, Artificial sequence
  Primer
  misc_feature (1)..(36): AY177695-13
tatataggatccggaccgtcagtccatcatttcgtc

SEQ ID NO: 329 - DNA, 35 bp, Artificial sequence
  Primer
  misc_feature (1)..(35): AY177695-14
tatataccatggtggatttgatgctaacaaaaagg

SEQ ID NO: 330 - DNA, 28 bp, Artificial sequence
  F primer
  misc_feature (1)..(28): AY177696-1
caagcaaagaaacaaatttcgcaattag

SEQ ID NO: 331 - DNA, 28 bp, Artificial sequence
  R primer
  misc_feature (1)..(28): AY177696-2
ataactgacttcatgctgcatatttgca

SEQ ID NO: 332 - DNA, 26 bp, Artificial sequence
  F primer
  misc_feature (1)..(26): AY177696-3
tgaccagaaaaacattgttttgctac

SEQ ID NO: 333 - DNA, 26 bp, Artificial sequence
  R primer
  misc_feature (1)..(26): AY177696-4
tttgggattggactgcatcccaggaa

SEQ ID NO: 334 - DNA, 30 bp, Artificial sequence
  Primer
  misc_feature (1)..(30): AY177696-5
tagcggcgaagaagatcgggagggggaaga

SEQ ID NO: 335 - DNA, 26 bp, Artificial sequence
  Primer
  misc_feature (1)..(26): AY177696-6
gaggtcggcctcaagatcttctccag

SEQ ID NO: 336 - DNA, 26 bp, Artificial sequence
  Primer
  misc_feature (1)..(26): AY177696-7
caaatatgcagcatcaagtcagttat

SEQ ID NO: 337 - DNA, 28 bp, Artificial sequence
  Primer
  misc_feature (1)..(28): AY177696-8
cagcatgggccatcgccagctcttctct

SEQ ID NO: 338 - DNA, 31 bp, Artificial sequence
  Primer
  misc_feature (1)..(31): AY177696-9
tgatgagagctcccagaaaaacattgttttg

SEQ ID NO: 339 - DNA, 33 bp, Artificial sequence
  Primer
  misc_feature (1)..(33): AY177696-10
tatatagcggccgcggtccgtttgggattggac

SEQ ID NO: 340 - DNA, 39 bp, Artificial sequence
  Primer
  misc_feature (1)..(39): AY177696-11
tatataggatccggaccgcaagcaaagaaacaaatttcg

SEQ ID NO: 341 - DNA, 32 bp, Artificial sequence
  Primer
  misc_feature (1)..(32): AY177696-12
atataccatggtggcttgatgctgcatatttg

SEQ ID NO: 342 - DNA, 26 bp, Artificial sequence
  F primer
  misc_feature (1)..(26): AY177698-1
aagatttgaactactgccttgtcttc

SEQ ID NO: 343 - DNA, 27 bp, Artificial sequence
  R primer
  misc_feature (1)..(27): AY177698-2
caaagatatttgcaatcctgccaaaag

SEQ ID NO: 344 - DNA, 27 bp, Artificial sequence
  F primer
  misc_feature (1)..(27): AY177698-3
tgattgccctctttccatcccaatagg

SEQ ID NO: 345 - DNA, 26 bp, Artificial sequence
  R primer
  misc_feature (1)..(26): AY177698-4
gttaacctaaaagaaatattgttcag

SEQ ID NO: 346 - DNA, 26 bp, Artificial sequence
  Primer
  misc_feature (1)..(26): AY177698-5
accaacctgatcaaaggggcgtggga

SEQ ID NO: 347 - DNA, 30 bp, Artificial sequence
  Primer
  misc_feature (1)..(30): AY177698-6
tccaagaggaggatcgggctgctcaagaaa

SEQ ID NO: 348 - DNA, 26 bp, Artificial sequence
  Primer
  misc_feature (1)..(26): AY177698-7
aggcactggcaagaagtacgagtact

SEQ ID NO: 349 - DNA, 29 bp, Artificial sequence
  Primer
  misc_feature (1)..(29): AY177698-8
aggaggccaacctgcatggctacgttctt

SEQ ID NO: 350 - DNA, 26 bp, Artificial sequence
  Primer
  misc_feature (1)..(26): AY177698-9
gctcgtttgatccaaggacaagatca

SEQ ID NO: 351 - DNA, 26 bp, Artificial sequence
  Primer
  misc_feature (1)..(26): AY177698-10
ttcctaaggacacgatggagtctgga

SEQ ID NO: 352 - DNA, 30 bp, Artificial sequence
  Primer
  misc_feature (1)..(30): AY177698-11
tgatgagcggccgcttgccctctttccatc

SEQ ID NO: 353 - DNA, 35 bp, Artificial sequence
  Primer
  misc_feature (1)..(35): AY177698-12
tatatacccgggcggtccgttaacctaaaagaaat

SEQ ID NO: 354 - DNA, 37 bp, Artificial sequence
  Primer
  misc_feature (1)..(13): AY177698-13
tatataggatccggaccgaagatttgaactactgcct

SEQ ID NO: 355 - DNA, 30 bp, Artificial sequence
  Primer
  misc_feature (1)..(30): AY177698-14
tatataccatggtggtttgcaatcctgcca

SEQ ID NO: 356 - DNA, 25 bp, Artificial sequence
  F primer
  misc_feature (1)..(25): AY177699-1
tccggtcggccctcgtcctccccgt

SEQ ID NO: 357 - DNA, 28 bp, Artificial sequence
  R primer
  misc_feature (1)..(28): AY177699-2
caaactccctcacgctgcgccaagaaag

SEQ ID NO: 358 - DNA, 27 bp, Artificial sequence
  F primer
  misc_feature (1)..(27): AY177699-3
tagaaacagatggacgcttgacgttca

SEQ ID NO: 359 - DNA, 28 bp, Artificial sequence
  R primer
  misc_feature (1)..(28): AY177699-4
aggcttggtgcaaggatacgaaatcttg

SEQ ID NO: 360 - DNA, 26 bp, Artificial sequence
  Primer
  misc_feature (1)..(26): AY177699-5
atcggccagaatcgggagggggcgca

SEQ ID NO: 361 - DNA, 28 bp, Artificial sequence
  Primer
  misc_feature (1)..(28): AY177699-6
agtcgcccccggccttttaagagccgca

SEQ ID NO: 362 - DNA, 32 bp, Artificial sequence
  Primer
  misc_feature (1)..(32): AY177699-7
tagtaggcggccgcaaacagatggacgcttga

SEQ ID NO: 363 - DNA, 33 bp, Artificial sequence
  Primer
  misc_feature (1)..(33): AY177699-8
tatatacccgggcggtccgaggcttggtgcaag

SEQ ID NO: 364 - DNA, 37 bp, Artificial sequence
  Primer
  misc_feature (1)..(37): AY177699-9
tatataggatccggaccgtccggtcggccctcgtcct

SEQ ID NO: 365 - DNA, 29 bp, Artificial sequence
  Primer
  misc_feature (1)..(29): AY177699-10
tatataccatggtggctcacgctgcgcca

SEQ ID NO: 366 - DNA, 27 bp, Artificial sequence
  F primer
  misc_feature (1)..(27): AY177700-1
ataagtatttcagaaagctgaagttga

SEQ ID NO: 367 - DNA, 27 bp, Artificial sequence
  R primer
  misc_feature (1)..(27): AY177700-2
caagttatgcatatttcttgcattttg

SEQ ID NO: 368 - DNA, 27 bp, Artificial sequence
  F primer
  misc_feature (1)..(27): AY177700-3
tagccgtcaaaggaccttggtcaattc

SEQ ID NO: 369 - DNA, 27 bp, Artificial sequence
  R primer
  misc_feature (1)..(27): AY177700-4
taattttactagtacttttactttgac

SEQ ID NO: 370 - DNA, 26 bp, Artificial sequence
  Primer
  misc_feature (1)..(26): AY177700-5
aagagtgaaacaacaaggtcagagga

SEQ ID NO: 371 - DNA, 26 bp, Artificial sequence
  Primer
  misc_feature (1)..(26): AY177700-6
gaaaggtgcaaatccgacgaatagag

SEQ ID NO: 372 - DNA, 26 bp, Artificial sequence
  Primer
  misc_feature (1)..(26): AY177700-7
attagctactaaagggtgtgtttcca

SEQ ID NO: 373 - DNA, 26 bp, Artificial sequence
  Primer
  misc_feature (1)..(26): AY177700-8
aaaatgcaagaaatttgcataacttg

SEQ ID NO: 374 - DNA, 26 bp, Artificial sequence
  Primer
  misc_feature (1)..(26): AY177700-9
taggattcataacgatggacatgttc

SEQ ID NO: 375 - DNA, 26 bp, Artificial sequence
  Primer
  misc_feature (1)..(26): AY177700-10
tagtaggcggccgcgtcaaaggacct

SEQ ID NO: 376 - DNA, 35 bp, Artificial sequence
  Primer
  misc_feature (1)..(35): AY177700-11
tatatacccgggcggtccgtaattttactagtact

SEQ ID NO: 377 - DNA, 35 bp, Artificial sequence
  Primer
  misc_feature (1)..(35): AY177700-12
tatataggatccggaccgataagtatttcagaaag

SEQ ID NO: 378 - DNA, 34 bp, Artificial sequence
  primer
  misc_feature (1)..(34): AY177700-13
tatataccatggtgggcaaatttcttgcattttg

SEQ ID NO: 379 - DNA, 25 bp, Artificial sequence
  F primer
  misc_feature (1)..(25): AY177702-1
tcttttcgcaaactaaacaaggcct

SEQ ID NO: 380 - DNA, 30 bp, Artificial sequence
  R primer
  misc_feature (1)..(30): AY177702-2
cacagttttcatgctagcatgcaagtaaag

SEQ ID NO: 381 - DNA, 27 bp, Artificial sequence
  F primer
  misc_feature (1)..(27): AY177702-3
taagactatgccgtacaagctggacga

SEQ ID NO: 382 - DNA, 30 bp, Artificial sequence
  R primer
  misc_feature (1)..(30): AY177702-4
ccgtggttgtcacagaagaccaatctatac

SEQ ID NO: 383 - DNA, 28 bp, Artificial sequence
  Primer
  misc_feature (1)..(28): AY177702-5
gagagcgaggagatcgggagggggaaga

SEQ ID NO: 384 - DNA, 27 bp, Artificial sequence
  Primer
  misc_feature (1)..(27): AY177702-6
ttacttgcatgctagcttgaaaactgt

SEQ ID NO: 385 - DNA, 28 bp, Artificial sequence
  Primer
  misc_feature (1)..(28): AY177702-7
atcctaaattttcatcgatggcatctag

SEQ ID NO: 386 - DNA, 29 bp, Artificial sequence
  Primer
  misc_feature (1)..(29): AY177702-8
gatcaggaccatgccagtctgatggccaa

SEQ ID NO: 387 - DNA, 26 bp, Artificial sequence
  Primer
  misc_feature (1)..(26): AY177702-9
gcacaaggaaagccttggaacatctt

SEQ ID NO: 388 - DNA, 29 bp, Artificial sequence
  Primer
  misc_feature (1)..(29): AY177702-10
taataagagctcgactatgccgtacaagc

SEQ ID NO: 389 - DNA, 32 bp, Artificial sequence
  Primer
  misc_feature (1)..(32): AY177702-11
atatatgcggccgcggtccgtggttgtcacag

SEQ ID NO: 390 - DNA, 36 bp, Artificial sequence
  Primer
  misc_feature (1)..(36): AY177702-12
tatatagtcgacggaccgtcttttcgcaaactaaac

SEQ ID NO: 391 - DNA, 32 bp, Artificial sequence
  Priemr
  misc_feature (1)..(32): AY177702-13
tatataccatggtggtcaagctagcatgcaag

SEQ ID NO: 392 - DNA, 30 bp, Artificial sequence
  F primer
  misc_feature (1)..(30): AY224482-1
tcttttcgcaaactaaacaaggccttaaca

SEQ ID NO: 393 - DNA, 29 bp, Artificial sequence
  R primer
  misc_feature (1)..(29): AY224482-2
tatcacagttttcatgctagcatgcaagt

SEQ ID NO: 394 - DNA, 27 bp, Artificial sequence
  F primer
  misc_feature (1)..(27): AY224482-3
taagactatgccgtacaagctggacga

SEQ ID NO: 395 - DNA, 30 bp, Artificial sequence; identical to SEQ ID NO: 382
  R primer
  misc_feature (1)..(30): AY224482-4

SEQ ID NO: 396 - DNA, 28 bp, Artificial sequence
  Primer
  misc_feature (1)..(28): AY224482-5
gagagcgaggagatcgggagggggaaga

SEQ ID NO: 397 - DNA, 26 bp, Artificial sequence
  Primer
  misc_feature (1)..(26): AY224482-6
cttgcatgctagcttgaaaactgtga

SEQ ID NO: 398 - DNA, 25 bp, Artificial sequence
  Primer
  misc_feature (1)..(25): AY224482-7
ctaaattttcatgcatggcatctag

SEQ ID NO: 399 - DNA, 26 bp, Artificial sequence
  Priemr
  misc_feature (1)..(26): AY224482-8
tgatcaggaccatcgcagtctgatgg

SEQ ID NO: 400 - DNA, 26 bp, Artificial sequence
  Primer
  misc_feature (1)..(26): AY224482-9
caaggaaagccaaggaacatctttac

SEQ ID NO: 401 - DNA, 29 bp, Artificial sequence
  Primer
  misc_feature (1)..(29): AY224482-10
taataagagctcgactatgccgtacaagc

SEQ ID NO: 402 - DNA, 33 bp, Artificial sequence
  Primer
  misc_feature (1)..(33): AY224482-11
tatatagcggccgcggtccgtggttgtcacaga

SEQ ID NO: 403 - DNA, 40 bp, Artificial sequence
  Primer
  misc_feature (1)..(40): AY224482-12
tatatagtcgacggaccgtcttttcgcaaactaaacaagg

SEQ ID NO: 404 - DNA, 28 bp, Artificial sequence
  Primer
  misc_feature (1)..(28): AY224482-13
tatataccatggtggttttcaagctagc

SEQ ID NO: 405 - DNA, 30 bp, Artificial sequence
  F Primer
  misc_feature (1)..(30): AY250075-1
gaaatggtttcattttgggacaagttattg

SEQ ID NO: 406 - DNA, 33 bp, Artificial sequence
  R primer
  misc_feature (1)..(33): AY250075-2
caaggattcgctccatactatcaataaaatatg

SEQ ID NO: 407 - DNA, 28 bp, Artificial sequence
  F primer
  misc_feature (1)..(28): AY250075-3
tagaagatgttcagatgaaatggtccct

SEQ ID NO: 408 - DNA, 31 bp, Artificial sequence
  R primer
  misc_feature (1)..(31): AY250075-4
aaaaaaatcaccggcgtcaaatatttaggga

SEQ ID NO: 409 - DNA, 27 bp, Artificial sequence
  Primer
  misc_feature (1)..(27): AY250075-5
agagagagagatgaaggggagggggaa

SEQ ID NO: 410 - DNA, 26 bp, Artificial sequence
  Primer
  misc_feature (1)..(26): AY250075-6
tattgatagtatcgagcgaatccttg

SEQ ID NO: 411 - DNA, 27 bp, Artificial sequence
  primer
  misc_feature (1)..(27): AY250075-7
cagttggttgccaaggcgcgttgccga

SEQ ID NO: 412 - DNA, 28 bp, Artificial sequence
  Primer
  misc_feature (1)..(28): AY250075-8
gagcctcggccatgcccagctccttcct

SEQ ID NO: 413 - DNA, 31 bp, Artificial sequence
  Primer
  misc_feature (1)..(31): AY250075-9
ctattattttaagaaagcatggattatatag

SEQ ID NO: 414 - DNA, 26 bp, Artificial sequence
  Primer
  misc_feature (1)..(26): AY250075-10
tgagacagacccatgcctgggcctac

SEQ ID NO: 415 - DNA, 30 bp, Artificial sequence
  Primer
  misc_feature (1)..(30): AY250075-11
tagtagagctcaagatgttcagatgaaatg

SEQ ID NO: 416 - DNA, 37 bp, Artificial sequence
  Primer
  misc_feature (1)..(37): AY250075-12
tatatagcggccgcggtccgaaaaaaatcaccggcgt

SEQ ID NO: 417 - DNA, 38 bp, Artificial sequence
  Primer
  misc_feature (1)..(38): AY250075-13
tatatacctgcaggcggaccgaaatggtttcattttgg

SEQ ID NO: 418 - DNA, 30 bp, Artificial sequence
  Primer
  misc_feature (1)..(30): AY250075-14
tatataccatggtggcgctcgatactatca

SEQ ID NO: 419 - DNA, 30 bp, Artificial sequence; identical to SEQ ID NO: 405
  misc_feature (1)..(30): L37527-1

SEQ ID NO: 420 - DNA, 26 bp, Artificial sequence
  R primer
  misc_feature (1)..(26): L37527-2
cagctcagatcggtctggacacaaac

SEQ ID NO: 421 - DNA, 25 bp, Artificial sequence
  F Primer
  misc_feature (1)..(25): L37527-3
taggctgctgagcactgccaatttg

SEQ ID NO: 422 - DNA, 26 bp, Artificial sequence
  Primer
  misc_feature (1)..(26): L37527-4
tgctggtgctcgaggtgctgagcgcg

SEQ ID NO: 423 - DNA, 29 bp, Artificial sequence
  Primer
  misc_feature (1)..(29): L37527-5
gaggagttggatatcgggcgcggcaagat

SEQ ID NO: 424 - DNA, 25 bp, Artificial sequence
  Primer
  misc_feature (1)..(25): L37527-6
acctccattccttgcatggcggcct

SEQ ID NO: 425 - DNA, 27 bp, Artificial sequence
  Primer
  misc_feature (1)..(27): L37527-7
tactccactccaacgatggcgtccagt

SEQ ID NO: 426 - DNA, 30 bp, Artificial sequence
  Primer
  misc_feature (1)..(30): L37527-8
acggcagcggcccgtccggcagctccggga

SEQ ID NO: 427 - DNA, 30 bp, Artificial sequence
  Primer
  misc_feature (1)..(30): L37527-9
gaacctctccatcgcgccgccccgggggct

SEQ ID NO: 428 - DNA, 28 bp, Artificial sequence
  Primer
  misc_feature (1)..(28): L37527-10
tagtagagctcgctgctgagcactgcca

SEQ ID NO: 429 - DNA, 36 bp, Artificial sequence
  misc_feature (1)..(36): L37527-11
tatatagcggccgcggtccgtgctggtgctcgaggt

SEQ ID NO: 430 - DNA, 36 bp, Artificial sequence
  Primer
  misc_feature (1)..(36): L37527-12
tatatacctgcaggcggaccgccaagagagccccct

SEQ ID NO: 431 - DNA, 31 bp, Artificial sequence
  Primer
  misc_feature (1)..(13): L37527-13
tatataccatggtggttgacagcctaaaacg

SEQ ID NO: 432 - DNA, 27 bp, Artificial sequence
  F primer
  misc_feature (1)..(27): L37528-1
accacctcaatctccactgtttgattg

SEQ ID NO: 433 - DNA, 26 bp, Artificial sequence
  F primer
  misc_feature (1)..(26): L37528-2
cagctcagatcggtctggacacaaac

SEQ ID NO: 434 - DNA, 27 bp, Artificial sequence
  F primer
  misc_feature (1)..(27): L37528-3
tagttttggtgtagacaccgtacgtac

SEQ ID NO: 435 - DNA, 28 bp, Artificial sequence
  R primer
  misc_feature (1)..(28): L37528-4
tgaaagctacattttagccttgtatttg

SEQ ID NO: 436 - DNA, 30 bp, Artificial sequence
  Primer
  misc_feature (1)..(30): L37528-5
agcatacccatccatcttgaacatgatggt

SEQ ID NO: 437 - DNA, 33 bp, Artificial sequence
  Primer
  misc_feature (1)..(33): L37528-6
catccatcttgaacatcttggtaaattctggct

SEQ ID NO: 438 - DNA, 27 bp, Artificial sequence
  Primer
  misc_feature (1)..(27): L37528-7
atgtgaggaccatcgattgatgcattg

SEQ ID NO: 439 - DNA, 27 bp, Artificial sequence
  Primer
  misc_feature (1)..(27): L37528-8
tagtagagctcttttggtgtagacacc

SEQ ID NO: 440 - DNA, 37 bp, Artificial sequence
  Primer
  misc_feature (1)..(37): L37528-9
atatagcggccgcggtccgtgaaagctacattttagc

SEQ ID NO: 441 - DNA, 36 bp, Artificial sequence
  Primer
  misc_feature (1)..(36): L37528-10
tatataggatccggaccgaccacctcaatctccact

SEQ ID NO: 442 - DNA, 28 bp, Artificial sequence
  Primer
  misc_feature (1)..(28): L37528-11
tatataccatggtggatcggtctggaca

SEQ ID NO: 443 - DNA, 32 bp, Artificial sequence
  F primer
  misc_feature (1)..(32): U78891-1
tcttcttcttgccttcatttgagttaattaca

SEQ ID NO: 444 - DNA, 28 bp, Artificial sequence
  R primer
  misc_feature (1)..(28): U78891-2
caagcgttttagtcatgctacaaagttc

SEQ ID NO: 445 - DNA, 29 bp, Artificial sequence
  F primer
  misc_feature (1)..(29): U78891-3
tgaacagtgcgtgcatgaacacctacatg

SEQ ID NO: 446 - DNA, 31 bp, Artificial sequence
  R primer
  misc_feature (1)..(31): U78891-4
gatgtttttttttgtcttttgatgcaaggcc

SEQ ID NO: 447 - DNA, 29 bp, Artificial sequence
  Primer
  misc_feature (1)..(29): U78891-5
agatcgatcgggatcgggaggggtcgggt

SEQ ID NO: 448 - DNA, 26 bp, Artificial sequence
  Primer
  misc_feature (1)..(26): U78891-6
gaactttgtagcatcactaaaacgct

SEQ ID NO: 449 - DNA, 28 bp, Artificial sequence
  misc_feature (1)..(28): U78891-7
gtccatgaaacaaaccgatggtaattgc

SEQ ID NO: 450 - DNA, 28 bp, Artificial sequence
  Primer
  misc_feature (1)..(28): U78891-8
acctacatgcccgcatggctaccatgat

SEQ ID NO: 451 - DNA, 26 bp, Artificial sequence
  Primer
  misc_feature (1)..(26): U78891-9
tcgtcgttttctcgatggccttgcat

SEQ ID NO: 452 - DNA, 28 bp, Artificial sequence
  Primer
  misc_feature (1)..(28): U78891-10
tgatgagctcacagtgcgtgcatgaaca

SEQ ID NO: 453 - DNA, 44 bp, Artificial sequence
  Primer
  misc_feature (1)..(44): U78891-11
tatatagcggccgcggtccgatgtttttttttgtcttttgatgc

SEQ ID NO: 454 - DNA, 39 bp, Artificial sequence
  Primer
  misc_feature (1)..(39): U78891-12
tatataggatccggaccgtcttcttcttgccttcatttg

SEQ ID NO: 455 - DNA, 35 bp, Artificial sequence
  Primer
  misc_feature (1)..(35): U78891-13
tatataccatggtggttagtgatgctacaaagttc

SEQ ID NO: 456 - DNA, 31 bp, Artificial sequence
  PL-5
  misc_feature (1)..(31): PL-F
ccgcgggcggccgcactagtcccgggcccat

SEQ ID NO: 457 - DNA, 37 bp, Artificial sequence
  PL-R
  misc_feature (1)..(37): PL-R
cgatgggcccgggactagtgcggccgcccgcggagct

SEQ ID NO: 458 - DNA, 25 bp, Artificial sequence
  PL-1
  misc_feature (1)..(25): PL1
gtaccggaccgcgatcgcttaatta

SEQ ID NO: 459 - DNA, 25 bp, Artificial sequence
  PL-2
  misc_feature (1)..(25): PL-2
agcttaattaagcgatcgcggtccg

SEQ ID NO: 460 - DNA, 29 bp, Artificial sequence
  OsMADS5-P3
  misc_feature (1)..(29): OsMADS5-P3
tgagcaggtagccggcgaccaatcgcgag

SEQ ID NO: 461 - DNA, 34 bp, Artificial sequence
  OsMADS5-P3
  misc_feature (1)..(34): OsMADS5-P2
catactgttacaaaaaagaaaatcagtggaccac

SEQ ID NO: 462 - DNA, 29 bp, Artificial sequence
  Primer
  misc_feature (1)..(29): OsMADS5-T1
atgaattgcttatcacattaatggacatc

SEQ ID NO: 463 - DNA, 32 bp, Artificial sequence
  Primer
  misc_feature (1)..(32): OsMADS5-T2
caaaactacatcaagagccttggaattggtcc

SEQ ID NO: 464 - DNA, 30 bp, Artificial sequence
  Primer
  misc_feature (1)..(30): OsMADS5-C3
cagtgtcgacggggcgagggaaagtagagc

SEQ ID NO: 465 - DNA, 40 bp, Artificial sequence
  Primer
  misc_feature (1)..(40): OsMADS5-C3
cgatccatggtggatactgttacaaaaaagaaaatcagtg

SEQ ID NO: 466 - DNA, 37 bp, Artificial sequence
  Primer
  misc_feature (1)..(37): OsMADS5-C1
gactctcgaggcgcgcctgagcaggtagccggcgacc

SEQ ID NO: 467 - DNA, 33 bp, Artificial sequence
  Primer
  misc_feature (1)..(33): OsMADS5-C2b
gtgtgtctcgagctctctctagctctctctcgg

SEQ ID NO: 468 - DNA, 46 bp, Artificial sequence
  Primer
  misc_feature (1)..(46): OsMADS5T-F
cccgggccatggggggtctagaatgaattgcttatcacattaatgg

SEQ ID NO: 469 - DNA, 32 bp, Artificial sequence
  Primer
  misc_feature (1)..(32): OsMADS5T-R
cccgggcgcgccggatgagaacagctacatcc

SEQ ID NO: 470 - DNA, 29 bp, Artificial sequence
  misc_feature (1)..(29): OsMADS6-P1
ctaggacgatggtgtgatgtgggaacacg

SEQ ID NO: 471 - DNA, 31 bp, Artificial sequence
  Primer
  misc_feature (1)..(31): OsMADS6-P2
gtacctttctaaagtctttgttatgctgcac

SEQ ID NO: 472 - DNA, 27 bp, Artificial sequence
  Primer
  misc_feature (1)..(27): OsMADS6-T1
gctaagcagccatcgatcagctgtcag

SEQ ID NO: 473 - DNA, 30 bp, Artificial sequence
  Primer
  misc_feature (1)..(30): OsMADS6-T2
gatgccattgtgtaatgaatggaggagagc

SEQ ID NO: 474 - DNA, 30 bp, Artificial sequence
  Primer\
  misc_feature (1)..(30): OsMADS6-P3b
cgagtcgacgaggggaagagttgagctgag

SEQ ID NO: 475 - DNA, 31 bp, Artificial sequence
  Primer
  misc_feature (1)..(31): OsMADS6-P4c
gactccatggtggttatgctgcacaaaaatg

SEQ ID NO: 476 - DNA, 37 bp, Artificial sequence
  Primer
  misc_feature (1)..(37): OsMADS6-C1b
cagtgcatgcggaccgctaggacgatggtgtgatgtg

SEQ ID NO: 477 - DNA, 29 bp, Artificial sequence
  Primer
  misc_feature (1)..(29): OsMADS6-Paa
cctcgtcgactcgcccgatcgatcgaacg

SEQ ID NO: 478 - DNA, 30 bp, Artificial sequence
  Primer
  misc_feature (1)..(30): OsMADS6-C4b
acgtgagctcgctaagcagccatcgatcag

SEQ ID NO: 479 - DNA, 32 bp, Artificial sequence
  Primer
  misc_feature (1)..(32): OsMADS6-C2
actgcggaccgatgccattgtgtaatgaatgg

SEQ ID NO: 480 - DNA, 35 bp, Artificial sequence
  Primer
  misc_feature (1)..(35): OsMADS8-T1
acgtgagctcactcctgaaggccgatgcgacaacc

SEQ ID NO: 481 - DNA, 39 bp, Artificial sequence
  misc_feature (1)..(39): OsMADS8-T2
agtcatcgatcatgacaaaatatcatgtttatttcgagg

SEQ ID NO: 482 - DNA, 37 bp, Artificial sequence
  Primer
  misc_feature (1)..(37): OsMADS8-Pcc
atcgccatggtggtcaagctgcaagtttcaaaaacac

SEQ ID NO: 483 - DNA, 25 bp, Artificial sequence
  Primer
  misc_feature (1)..(25): OsMADS8-C3
acgtgtcgacgagagggagggtgga

SEQ ID NO: 484 - DNA, 27 bp, Artificial sequence
  Primer
  misc_feature (1)..(27): OsMADS8-C5b
tcctcctcctcctcctccacctcacct

SEQ ID NO: 485 - DNA, 41 bp, Artificial sequence
  Primer
  misc_feature (1)..(41): OsMADS8-C1b
aactaaatcgcctgcaggcggaccgttttttgcgaaatgcc

SEQ ID NO: 486 - DNA, 10 bp, Artificial sequence
  Oligo
  misc_feature (1)..(10): 8PA-1
ggagatcggg

SEQ ID NO: 487 - DNA, 14 bp, Artificial sequence
  Oligo
  misc_feature (1)..(14): 8PA-2
tcgacccgatcacc

SEQ ID NO: 488 - DNA, 33 bp, Artificial sequence
  Primer
  misc_feature (1)..(33): OsMADS8-C2
acgtcccgggcggaccgagtcatcgatcatgac

SEQ ID NO: 489 - DNA, 38 bp, Artificial sequence
  Primer
  misc_feature (1)..(38): OsMADS8-C4
tcgagcggccgcaggccgatgcgacaaccaataaaaac

SEQ ID NO: 490 - DNA, 41 bp, Artificial sequence
  Primer
  misc_feature (1)..(41): OsMADS13-C1
gactgcatgcggaccgttccaaaattaagcacacacatttg

SEQ ID NO: 491 - DNA, 33 bp, Artificial sequence
  Primer
  misc_feature (1)..(33): OsMADS13-C2
gactccatggcttcttgctctcaactgatcaac

SEQ ID NO: 492 - DNA, 33 bp, Artificial sequence
  Primer
  misc_feature (1)..(33): OsMADS13-C3
tcgagcggccgctgacatggatatgatgatcag

SEQ ID NO: 493 - DNA, 36 bp, Artificial sequence
  Primer
  misc_feature (1)..(36): OsMADS13-C4
acgtatcgatcggaccgcaacgcacgggcacccaac

SEQ ID NO: 494 - DNA, 9170 bp, Artificial sequence
  vector
  misc_feature (1)..(9170): pNOV6900
gtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccgaattcgagctcggtaccggaccgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatctgctagccctgcaggaaatttaccggtgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaattaattcctgtggttggcatgcacatacaaatggacgaacggataaaccttttcacgcccttttaaatatccgattattctaataaacgctcttttctcttaggtttacccgccaatatatcctgtcaaacactgata

SEQ ID NO: 495 - DNA, 4700 bp, Artificial sequence
  vector
  misc_feature (1)..(4700): pNOV6901
cgatgatatcagatctggttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttaacctggcttatcgaaattaatacgactcactatagggagaccggcctcgagcagctgaagcttgcatgcctgcaggtcgactctagaggatccccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatcaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgcactagtcccgggcccat

SEQ ID NO: 496 - DNA, 30 bp, Artificial sequence
  Primer
  misc_feature (1)..(30): OsMADS8-P1
ggtatctttccaaagttctggtcatgctgc

SEQ ID NO: 497 - DNA, 29 bp, Artificial sequence
  Primer
  misc_feature (1)..(29): OsMADS8-P2
ccattttttgcgaaatgccaaatcctggc

SEQ ID NO: 498 - DNA, 21 bp, Artificial sequence
  Primer
  misc_feature (1)..(21): GUS5
atggtacgtcctgtagaaacc

SEQ ID NO: 499 - DNA, 28 bp, Artificial sequence
  Primer
  misc_feature (1)..(28): GUS3
gatcgagctctcattgtttgcctccctg

SEQ ID NO: 500 - DNA, 21032 bp, Oryza sativa
  misc_feature (1)..(21032): CL000624.108 (OsMADS5)
  misc_feature (1)..(21032): n is a, c, g, or t
  misc_feature (11)..(11): n is a, c, g, or t
  misc_feature (90)..(90): n is a, c, g, or t
  misc_feature (141)..(141): n is a, c, g, or t
  misc_feature (5283)..(5283): n is a, c, g, or t
  misc_feature (8576)..(8576): n is a, c, g, or t
  misc_feature (1)..(21032): k is g or t
  misc_feature (1)..(21032): m is a or c
  misc_feature (1)..(21032): r is a or g
  misc_feature (1)..(21032): s is c or t
  misc_feature (1)..(21032): v is a, c, or g
  misc_feature (1)..(21032): w is a or t
  misc_feature (1)..(21032): y is c or t
tttaaaggggncccmkktttcrgggttgtyccggggttttaraactgrgccargaaagtmtggcaaaaacrgtgaactgggsagwttttngrccttttttgctktcragkgmccttggtatctataaactgaataacctgnggattacacacaatcgacatattcagtattgaagattgcatgrgaacttaaaatgaacaagcacatactgtaacaagacatgacataagcaattaaactgtcgagaacaattatatatataagtctcttttagtctttctgcaacttcactggtaggcaattacctatttcactggttgctactgagtcaacaacctgtgcatatccgtagttgtttttgaccccaacaaagtcttcattgataacaggaaaatccattgcaactttctcatctgtaagataaccttcttttgtagttccgcttttcaagtttagcctccattcatatggacgagaaaagagagtgccatctactgatggatcaaaaccttctgaattcttatctggctggagaaatgctcttccagaacattttgacttgtcgtcatcatgacttgcactagagagtaccgaatcaagtgttcgacaacctctgataacaacctgtttacaggcttttgccaatgagtataaatagacggaaaaaagcatcgctaatctatattttctatgagattatcctcatgtatgtgacataaacccttttatgttgggaaaattagaatgtttgaaccacaagaattacacggaaaaattgttctattagattgattttctgattttgtttctgtactctaaatgcatctatggtaaattaatgattacataactaggtccatctgaagtttctataagcgtaatatcgataggatttttggatctcgtgtgataatttaatacatgaatactgattttgtaaaggttctagcgaaaatactggaaaaatagccaaataggcagtccatagctaagtaaagctaggtagttagcatgttgcacactacaattttgattcataaggcaaaactacagcagaatataaagctttttctggataacagctaatcatatccatatatttctctggaccaaaattataagaccatcaattgaaatagcagaaagattaatccagaatgtgtattatagttgcctacagatttttttaaaaaacgatttcagtatggtgaacatatatacaagtgcagctacatgcctcatgcaccagatccactcatcccacctctagtatgaaattatcagtagtgttataaaaaaaaagaagcaatgtctgttctgaacctccaatgaccattaaagctgtttcatgatccttaattttatcttttgttaaaattgaacaatcacctcatttccatcctcaaagcaattaaataaatggtaactgcaatgattctccacatcaaaccagatgatggaatcagcatcaccaaacctaggcatcactccaatgcgtgatatcccgcccatatcattttggatgaatctgaagagaaacataaccacattattatggattattaagtcagtatgcatatttcccacagaagtggttgtcatagtaaagatggtgtatatgtatgggacccacggtttgcgtaaaattgtccttattaagccgaagtggagaggatagtccattataatattgtacctacaatataataattagtagttacaagaaaacgtattgttgacagcaatataagatctcataaataaaagctagcatactgtgcagttactccgatgtcatgaatgagttttccttcctcgaatttgagatcgaccttgtgaagaagcctctcaccatcagctagttcatgtgaaagaacatcacttaataatattgtaataaaatctaaaagatcatttttgcccacaataatagcaagcaagacacgtgtgtggttgagaaatttatattggttcttttgatacaatgtttgttgatatttctaatcttatctagctgtctttttttttcatgtaactattgccagttactatagtaatattgtgttccgtttacactttatttttattacttatatgccactcgataatttgcaaaaccccagcctggacaggcgctatcaaacaaggttcaacatggtggatctgagtgcatgtgctagttaaaaatacgagttgcatataacaaatgctacaaaaggttggtgtaatatactctccctgacccaaaatgtaagggattttsggagaywtgcatatcccargactatgaatctggatagggagcacgtccagattcatagtcctagatgtcgcatccacccaaaatcccttatattttgggatagagggggtagcccattttcatgtattgttttacacttgtctagtgattgcatttatgttccaccaaatcacaacttacaggaaattactccaagcacatagtggggtttttcaatattagttcccatcgtcacgagttctccacttccacaaatcttctgtaaataaaatcatatgcatgtaagcccttgctatagatgaatgatgctgctcacaacagaacattatgaacaatttgagtaactttagttggcattaaaaatattccaagaacattatgtgtttgaactttgagttgatgatccatgcttcagtaatcattcaccatgtgaatttgtgaagttaagaaatggtggctgatggattaattgatgaaagatctctactgaaaattattgaataataatattaatatatcactggccttgcctactgttcatactaaaacatcaaacacacatttaaagaaataatgagcaagctgtaattgcataatagaatacctttgggtggctagtgaaaggttggtcccaagctccattaatgttgtaaggtcctagggtgcggagattattgatgtcaatttcgtaaggtagatgattttctgtggcagcaaaagctcgtccagcatgctgaaatatggaagtatttgcactgtccttcacaggctttccaaatctcacctataaatatcaccgaagatgatatgtagtgttaaccatcctcaagaccaagtttaaacaaaaaaatcatgtgcatctgacaattatatagctactcaaattccatgagaaaatgattcaacagcggcattcagctttttccactggagaaacaactaatttgttgagtttcagatattatgtaaatctattccactggagaacagtggaattttttacatctttctcatgtcgattcttcttgtattgaaataagaatatttttttactatgcagaaaaagactgtttcttatttatttgggtatgtatattggactgccttttcttatgcaatgcttatgtcacatccagtagttaatctgttctagatattgatttaacctgcacatcatattttcgccgtgcatctgcacatcatattagagctcaattatcctatccacctagtgtttacacttgatctaatactaaactatttaaaattaggaagacttacggtattaagaagaaaagcaaccagtgttgcacatggctcgccttcagcagatggaaggaaagctattttgttcttctttctctctaattcaaaagtgtctgtgtccacatatttgttcttgtacgaaatcctccattctcctaaattgctcttgctaaggtagatagcatgcaacattccatgtccttcataatacatgtatgatgttgggccaaagatggactctgcagctgtctgtgatgcattaagagggtttggacctgttcaaatagatcaatgttacacgtgcatagaagtttagcataaatctgattcattattaactttttttggttggaaagatgtatataagcttgtgagcctggaagtatcagaactcaccatttcttatatagacaccctcaggaaaatcttttggaacctctccattgagatcgtcaatgaaaacctcatcaccaatttcgtttacaggtccaaaattcccctgtagaagactcagatgaaaattatgccaaattgatgagtcagataaattggatactacaaaggagatggaaaaaaaaagttgctcgtcgacttcacaaatttgatgctgaacaatgtcatgtttgcaaattatatagtagcacatgcatacattaacaatctttatatttacctcattcagataaggctgctcagaaaacttgtacacggagtcgatgaatcggtccagcagatctgaagagactgatttcagagcttttgtcaattcctgcatcagtggctgcttattccacccagtaactgaagattgcacctgaaggatggtacattttgaggtaacctatcccttcttatattgcacaaaatattgacttaagaaaaacaaacgcagagatctgaaggtcctattgaggtagatgtagctttatctcaactgaagaacacaaatttgttacaacacattgaaaagtttctttgttttttttcttgggagaacttacaacacgtttcaaagttagtacttgaactgcttgctggatacatgtaggcaggcatgttccatccattggtttgtctggagacatcaagttaataaatcattattatttccagattagttaccttgacggcattaggtggagacaatgaggaagcttgatcagctgggctcttccctagatgaatgcatctagtgacctgggagctgcaccctccagctctgaacatggcttgctcaggttattcgatcctctcttgtcagttgtaaactgttactggatgttatgcctgctagttcgagcttgttgcattataaagtggaggagcagtaagccagtaaggcatgcaagaacacagacaaatatggtttatcccttgctatgcatcggccatggggaggaataaaatggtctgattggttcagactagcttaagagcaaacactacagtagataaggagcatattcttgatggtcwgtgggtgcaataagacagggttaattaatcaagaacaagttgattaatatatggtcgcagaaatcagttctggaatcaggctcaacaagggatgcaagtgcaactaggactgatttagtcatgtagtgatgtagatcgtgatttgtgacctgcgacctttgtgattgatttgctgctgggttggcagctctgtccgtgctatgagctcgtgaatggaaggaacaccagtggcgaatcacaatgacgctcatcaggtcaatgtcttttttgatgtaaantcaggacatgttaatcacgatgatgctcatcaggtccatttcttttttaaaagtaaaatctggacaagttaatcacmacacsgctcattaggtcaatttcttttttaaargtaaatcaggacaagttgtaccacatggaatttcattacggaagtagttcaaattaggctggctttttgttgtctaatcactcttgttgatatgtactccttccgtatttaaacatgtcattgtgattttattagtttgtggaaatataaaaatcgtatgggtccatttttccttataattttgttagatactatcgttatatttaaatacgaaggtagtggcataattgcagtgtaaaccccccaaaaaactgaagagatgcaggttttttgtacttagcattcgcaaatacagtaagagtttggttttgttcgtacatacatgcacgtatatacaagttcacaagaacagcagtcaaatgtggaccatgcgcaatggacgatgggttccaacttccaaatcttagtcgggccgttgcttcaccatgtgggctaaagatgccacgcgaccaaagcccaccaccacaagtggaccaaaagcccacataaaccgagggtaattggaccgacccaacctgggcttcccacatgggcttaaacttattcgcgccttctccttaccaggcagcccatcagaataggccagccgcgtattcatscaatscwvagattgagatggactattattacgcatcatcaaaatgttaaacgaccactttcaaaagaaaaaaaaaagagcattgtacttgtacgaacacatataccttcgttgcaatcacaaattcgcaatcaaaagatccaagttcatcacatggccaactgcgcgagagatgacacaacacggctgaaccgctaaaaaaccgctacgaaaatgttttaggatcatctgtgcattcttctctgtttaaggttggtaacagagcatgcagtgctaccttcgtctcgggctcgtggcacgaaccgccaaaaatcgacggcgatatcaacctcgttttgtttgtgaaacttgtatgtccgtggtaggttgtagcggagctggaacagagggaaatacagattatcatagcaggaacaaaactggaaacagaaaacatatgttttgacccgtaaagccttaaatgtagaataaactcatctagaamccaatcaactttttgccggatttcaagcaaaactagaattgctagtcaagtgttatatcccggtatttcaaataatataaagaaaacaggtgcaaaaatggtttaaaaaatcataggtagctcaatatcgcatttcaccattctatttgcccagatttcctacagctagcaggcactgaatacatttggtcctccaaactttactcatacccaaatgtctgattcagtctaaatggaagcaagaaaacmaaaaaaaaattaacaggataatttatttactacttccccattgaaatactgaacaacatttttagggggtagatgcacaatacaaaatgataagcgcctagcatctatttagttacctcacatagaacctcggcacttatggcattgcagttgcgcaaggctaccttcttgatgtgctaaagatcagacacaaaaaaggtggacaaaaaatcaattaataaaacttccatgctaactacaagatggaacattgataaatatggttacttcttgttggaaatacactgttgcaaatagagaagggaataatcaaacatttatcatcagaatctaataaaataaaagagagattgtttctgacatttgtaatccccttgaggaacacttacttctctggtagaagtcttgtgtagcgaatagacagctcgagtggcaacctgcaaatagcaatagatattaaaaattttaaacatcatgcaataatctcagtcatgtgtatgatggcaactgctgcccagtgccctcaccttcatgcccatagaaatgaattccatgtcagctccttttctgcttgtcccaaagggaggattcatgacaacagtgtcaacaagaaggcctacttcaacaggtagctaaaagatcagggaagcttttcaatgttgaaagcatctacgcttatgtgtataaatatatgattttgtttcaataaccattcacattttttttgtgacactatattatctttcttgacctgaacaatggtgcacaggctattgaagtactggagagaaagtaaatagctgactcgtatagtagcatcagctaggatactactctggatatcttctctaggtgctatctacttatgtatgaaataacaaataaataacatgcaacagaaaaaaacagtgtgaaaaaaaaactatgagaagatcagaagcaataggttatatagaaaaataattaaaaaaaaaactgaactaaaggtgcacttaaactaggtagagtatgtcatcatttaaggacaatacctctcaaatttaaattctttatatcacactgaattaagtcgatatccagctgcacatcaaacatttaacaaaagaaacatgtcattcacatagtcaagtattgttactgatcctagaaataactatccctgtgtccaaaaatatagctgtttatggctactatattttgggacagagggagtgatacattaaatctgagtctctgctttcagccctactttgccaacatttgcttagccatgcaaatttgaccactaatactaaagaacatgaatagagacagagacagtaaaacctatatttaaaaggataatctagacagattagtagatcaattgaacagaacaaaattattgcatctttacaaaagaagggaagcatactaagccatttatgaaatttctatgatgcattgataaaaataatccatggcagtagtacatataaagaaatgcaaactgcaatatttgaatataaaaaacatctcagatgtggagaactgaaaacaaaaatcaacacctgtagtgcatttcagtagttgcagaaagctgatttaagcatacaactttccacaatgctatttggcaggaagacgccattaacaatttgcactacatacagatgagaactatcagaaaattatgactacaataacatgcatagtttggtggtgatgcaaggaggatgctggaaaaaggtgaaaacgagagggtacatagacaatgtgaagatttttcaactttcaggctaaaccaatggttatattcggaaccaaaaaaatgctatacctctagatctgcagcattttcttgagcaagttncaagggattgcgggtcaatatcaattccaacaacatgcctgtgattcacaaccaaagggacatwagattggaaattgtaactgaacaattaccaccaaaaggcataaagatactgagtgatgaacctcattttcttgtttctaatactaatcgacgagcacttaagttctgtaactaatgtggtgagcaagtggctaggtgaactaatgtggtgatttactgtccactaagttctgtaactgatggtatatcaacacacaagcatcatggacagatatacttattaggtaaagcttaaacaagggtaaaacatatccagacagcacaatcagtcaccatacagttctccattttagatacaaccattctccattttaggtcagtgagtgttaatatgcgacaatgtcacatgatgttcagtcgaattgaatataaaagggcaacacctttgcacagttaacaaatgatatctttacaaatatcaacacagaagaaaccagttggtcaaaagaaagaaaacccaaggatgtgggtgtccaaatcttaagatcttaaacatactcactcagcatccagcagagagcttgccacagacagggtgccacacccgcagccaaagtcagccaccactttgccagttatgtcatcaaaactattctccgcctgatggatttatggaatcactatgagcgagataaaaagcacaccagaacaacttgaatgttagcatctgaacagcgcacatgccagccatctactatttgtcaacttgatactgacaaaccacaaaagtagacattgccaacggttgcaacctgcaaatataggtgatctgccgaaacaccagaacctccaaagtatctacttcgatggacatcgccaaagtttacactcgatgatggcttatcaaaactaaaggctcgaaagaccaactacatgaataacaactattctaagaatttcaaagcactaagaagtctgaaatcgctacatgcctagaggaagagccactctactcttagccatgaacctactactgctggtatgctgcttggtcggtttggacatggaaccaaagctgctgcacttgacgtcgcccaattccactcacatcacaaaaggaagaaaaaaaacagcaggatcgtattcgaagaccaaagcmaaagattaaaaaaaatctacactctagtataaagcacaaaatcaaagcaggaaactacacggggaatcggaacaggatgctactactaccgtgtagagcatccgcgacgcgatgtgagggcccgttgcatactgctccagctccacctgcacccaccgascaccaccaccaccggcggcggcggcagaaaaggtcagacatattcccgccaccactttgggcggcgatgcgaatcggaagacaagacgccggcaaagtgagtgcgcggcggcggtaaatttaccttgggtgcggtgaactgctgcaggtctccgaggagaccctccagctgcttcagcttcatctcctcctcccctygscgccgccgccgccgtcgtcgtcgccstggaagatggagctctctctctctctcccccamtgccgggccsgaggctttgccttttttcttagggcsgcgcgggtkggaccgggagattgggcccatatggcccatctctaatgggccccgctacattgattgggccacgttgggtcttgggccggataggaaggcctaatacgagtgagtgggcctattacatcatggtcctcgtggataattgggccgataaaatgggccgcstgggcsgtggagtcgaaacgtcccgccgccgccgcggccgtcgactgcgccggcgaactccgcgttctccggatgcgccgcgccgcgggktgggggattttttgcgacgtggagttcgcgccgcgcgacgccggaggtgagtgctccgcccaccgtcgtgctctcctccgtttcgaactggcaattgataagctttgatgtctaggtttcggacggcttatgaagttgctgaactgggatgcgaccattttttttctccgattgaattttgaagcaattcagtgcaaaggtaaatggcagggatttgcaatttgagatgctaatcttttgtccctgcaaggtgaatttcgcaacatttctgtgcaaggtagtggcatgaatttgcaatttgatagactaatatgtgtccctgcgaaagttgaatagttgaaacaattttgtgcaagctgttggatatgctttggatcggtttggcacaaagtggaaccacaaattaaaataggtttggatcataccttgatctcccggagttcccatttctctgttgtttgttcttctttcttttcctcttgtttggaagcacagagaggagagagatgtgctatggctcttccctgtgttctcagtgggttgctagatcgggtagcgagagaaatctcttagggtttaatacttaggtgttgatttctatttatagccactgcacacagggggaaccgacactagtggaggcggtaaatcccccgatcagggactttcttgaaggggcgatcactgtagcgattgccctaaaaaatctttcttgccgactttggtttagccgcaagatcacatttgtgttcacagtaacacaagctagtgccatgaatttgcaatttgatagattaatctgttgtccttatcgaagtgtcaatttaagttttgaatggtttctttacctcaaaaaaaaaaaagtttataatggtttcatttacattcagtaccttggtagtacctggcaatattattggtcattgctcaagataagtgttgaaacatgatcatgtataggcttgattactgaccggatatataggtttcttggtctcatttcacaagtctttgcacaccttaattgagacgtttagtatatctgcatcacatggcatgtaatccagtcttactcacgactaccatgttgcaatgggtgggtatgccacgttttgggagtaatgcatgcttaattctctcttgcatgaagtaatctattaatgaaaccaaatgaggcgccttaactcgccaattaatggaaacattaaactctatttagtcgtggtgtttaagtttaagggccaatacgttcttgtctagatatattatgacatgttatgcctgtgtctcctcccctgaaagatgcaggcaaagaggggccatatttttcaatctctctccccaccccctgacttgagcttctgaaatccaccatggatttcagttgcttgcagccacattcaggaggttgtgatgatatgccatttgattcctatgtgcagcaaaatggccatcaggagctccatcttgttgatcatccattcaacaatgtcactgacggccatgaatactattctccatctgctggtggatcttttcttccctttgcaacctactatgatcttggccatgagtactaccctcaaggaggagaaaaggatgctgtcgtcgtcgatcgggcttcgccgactattcgtaaagcttcgcctcacctgcctctcttcacacctaaatctgaggtttctcatctcataggaggcggtgtcgttggatcatataaggcatttgagatgaattctaggcttatccggcgcaaaagggcttcgggtaagtctctgaagaaggctaatgttgtcaaaggccagtggacattggaagaagacaggtaaactaaactaaatttgtccatgcatgttctgtttaatttaacctctgtatgtccacctaaaggagttcatggttagtaggacataggattgttcatgttctccctagtaattgacaaatgtaaatgaattgattcttgcgaaatttaaacaggaagcttgtgaaattagtcgaacagtttggactaaggaagtggtctcacattgctcaaattcttcctggaagagttggcaaacagtgcagagaaagatggcacaaccatttgaggcctaacatcaaggtactctgtgctcctacattttgtttgtccaagtactgtttcttaatttgaaaaggatataatactgtctatttcgatgctttcagtgcacagaaaagaaaatgttcttgtgaataatgcccctgcatttcaatgttgttcgatatttccttgttttacttattgcttgtttgaacgaaattcctcaagaaaagccaattttgatacattcatatcaatgctaataaactccccaatacatttattctcccttcacaaccttgagataaactccccaatagaatactgtctattttgaaggtcacggaatctgaacgcaatgtgtaaagtaaatgtttgaagctagtcaaagattaaaaactggtctaagagagagcattgaatattgatttgaatacatttaaatcaatcctaataaaaaaattgaccttaaactatccctaaatattttcctatatagcattcgatcattttgattagcccaacattcacaagtgctcaaggacagtttcttcttgataagcagggagccaggataaggtggtgttctaaatagaaaggaagccacagaaattaggaacaaaaacgcttaggaagcatcacagtagatgagaattagaaaagctaaatatcattttgcaactgttaatatcaaggagaaaccaataaatctataagaacggatattcataaaaaaaattggcatgttcctttttaaaaataaaaactgacatgttagttttcatgacaatcacactttttatagagtttccatgcttggaataatccttctgtgtaacaaaaaaaaatgcagaaagatacatggagtgaagaggaagacatagttctaatccaaacacacaaagaagtgggcaacaaatgggcagagatagctaagcacctgcctggtagaacagaaaactccatcaagaatcactggaatgcaacaaagagaaggcaattcgcacggaggaggagccgcgctagctccaagaaccccaaatctggaacccttctgcaaaactacatcaagagccttggaattggtccaatcaagtcaagtgttcgtcaagctccaccagaatctactgcagtgtcatcgtcttcaccagcatccacacaaaagttagcagaggtgaatggtaagatcaggccagattccaacccatccaaccaaatggtcacccagggaatactcaccatggatgagaacagctacatccagaccaactcttgtgaagaactcctggtctctacctatgatgatttatgccttgatatgtgtgatcatttgttcgaaacgaaggacgagatgccgtaccaggtttacaacatagatgatgatgttgacatgaactacatcttcaaccacattgattatgctaacaagattggccatgagatagatatggaaatggcatgggacgatgatgtcctccaagacgatgaatcagctggatcatcaccattggagacaccggcaggtctagcacaaatcaataccgtgcatgtgaaggaggagatggatctaattgagatggtcacacgcacacaatcttgtggctagtggatgagaaaataagcagtgatgtaactatgtgtgctactaaatacacattacacgacctttcggagtgcaacctggggaacctatatggtgaagaaatattagaaaaataagaaaaacaaacatgtatgggttcgaacgaagcacttgattatatattatattgtaactaatattctaagtttttctcttcgtacttttggcatgcactctctctttaataagtactttatttttaccttttcttacattccaatttactcgttttatctactcacacttaattagttcatgctgagaaacaactagtgtggtatactcacatatattgaacacagaccaattaaggtaagaattaggcaacataattataagcatatatctaagctgacatgattagtggtcagttaattgtttacttcgtatttattaattagtaacaaaacatcttcattacatactgaattcagactaacatatagattatgttcttgcagcattcatcaatcaaaccgggatcattcccttgttcagttcaaaagagcctaaacaaacgcactaaatttagcacacacacttaaggtaaaacccgcatgttaaagagagcatttacgtcaaacaccacatccaacatagggagatgtccattaatgtgataagcaattcattcattggttgaggtgatccatgtaagcttgatacctgcatgggaraagggaawtgacgaccgaaattwacmccatatattttaaaataaaaaaattggaccaatctaggaaggagtagattgattttgaattaaggagggggtgagactcaaacccggaccggctagttcgcagcttgcgttgctagccggaaagaccccgggcctttctccaacaaactccaacataaattaacacatatatttatgttaagtatctaacaaactccaactaaaaagaaaatgctttttaaagttctggacaaagttttagtacacatcatcgttcttcagtccctaacagtacgacgaactactttttttttatcttgccaaatttagttcattaaactctgagttaaacttgaagctagctagtactactaatttataatagtgccttgtctccttttgccccacaatataggaagcgaaacatatgtagctcacattgaactttgattaattagtgaatattgatttagatagttggtcaataacaaattagatcataacttgtatgagctgaagtatacaaattaccctatatgcagggaagggtcacaaattgcatgatggagaaactcttggttagcttcactagcatggccactgggccctacatcttggcaagatatatgaagcatattttctccactagtttcttgtatctgttgcaataaaaaagatttttagttaagctgaaagaactgcaattccctttttaagtatatacacaagcaaccgaaatgattcagatcacttcaatatttaaccatgaatttaagaacattatacatccctttgccttgaaaatttaataatattatttggactagtatattaatatcaaattaacagctatggggattcacagtaccactgaatttgagcaaggccattattaatttgattgcaccgtctatatttctttagataaataacgtgtaaccgagcagcaagggattattatattgctcatgtgagccttcagaacgacagcaatcggaagctagttcgagaaaagagtaattagtttcttaatttattagttggattttctacctcataaatacatttgatgtattaaataatacctctgtcacaaaatataagaatttttagggctggatatgggtattaaggaagtaagaaaattaaatcggaaaatgttgataagataatttagatggagaagttgttatatttggggatggatggagtatatgctaagagaaatttattgttcattcttattgaagctacaaatagtttccctcaaaaaaaattatcacatcttttttctatgtgtttgtacatgtaggatatgactcgatcgtaggcacatggaaattatataacatactcatgctcaaggctagcagctccggagagagagtaatataattaacgtttggagttttatcacatatggagtatatatactaatctgtatatattaccttcctttttaagtctttattagcatcttgaagttgttgttcctgcaaaacttatcagttattatttctggggactagatagtagtcaaaagattaacgaaaacgtacccataaaacaaagacagcacacacatggattaccttacgtttgagctcaaatacttgatcaagcaactgttgattctgtaaaaatgtatatacaaatgatttaccagcaaagtttgatcaagttaaaatttgatgtttcatgtaatacttgcgtaacaaaaccaaaaaaaaaaaacagagcataggtaatatataacatataagatggtgtatatgatgtataaagtactgtgtcaagcgggaatcaagctaaatatgcgtcgaaattaatatgattcatttcactatgtaattacctttgatgacctgatattcatgagggatatctcgatctggttctcaagttgctcgagctccttcaagctaagtggaaccaagtcctcgccaagaagatttctgcataagatcagagttagtccatgtgtgtaacatgtagaaaagctttctgagaagatccacgtgcatacctctgagttgtttgtaggaactcaactcttgtctttaactttaagtactcttggtaattgctctatatgaatgccaaattagcagccaaatattaattgaaagaaaatcatgattactatgtaaaagttgatgagttggaatatgcctggcatagaactaattaaattggacatgagaaattaattaattaattaatagacaaaacttaaaatggtaatggcatatcatgaagtatatacatactgcatattgctaattgttgtgttagttgacaacagaacttatttgttacttcctccgttttatattataagactttctaacattattcacattcatatagatgttaatgaatgtggacaatgctaaaaagtcttataatatgaaacggagggagtagatatgtagcatgcatgcatggataatacttgtttcgtcctcgatatatacatatatagctgctgttcaaaaggggaatataccctgcgcagaatgtactgtaaaaatgtaatttaaaagacaagtctgtttaaaatatacattaattaacctatcatgtctagcatattatacatctatcatgcacgaacatgagaattatgtaaaattttaagatatcacatacgttttattaaatattatgtatggcagtgtacacatcgatatttccttgtaaacaataattgtagcccctatcacaacgtataccagattgtgttaattacataacttatatccaaaacaagcctgattctcctttattaacagctagcagcagttgctgcacagatagagatgattcattagatctaaaaatatgcttggccacatagatcctcatgtttcaactaatgaccaaattaagttcaattctttgaaaaagtttaaggaaccatagtttattacaggtgaattgcatatgcagcaatcatattcagaatcagatggttactagttcagtttccagtgcagcagatgcttcacatgagttaaggttgtagttgcaactgcggtatcgctccagtgtcttgtacatactgttacaaaaaagaaaatcagtggaccacaaaactattttcaatgcagtatcagttaaagttgttatattatattttgttgtttaaatacatgtatatacaacccgattttcctacatatgcatgatcagtttattttgcctttcataattaatggagcatatatcagttatattttctagggtatgtgcacagcgcaccctaagtttggagccagggttttaaatttcgaaagaaggatttctaccgcaggtgggcgatataaccaaaatttcagatttttttttcgtacgattttttttgaatttttgactgattttgaatggatttgaataaaatttgaccaaattcacaaaaatttgcaaacaaccgaaagtttcgggcgagatatgaacatttcggtgggggcgaaatttcgagccgaaatttcaaaccctgtttggagctataaacactatcacttacaaacatgtatatatttgattgatttgtgttaaattattagaaaattgtactctgtttttttagaaaaaaacaattgtaactaacattcagattttgtttcaaaataagtgcaattctaaaggagtgcagtactatttttccctacaaccacccccctcattcaaattatgatccctattttacccccaaccacaatttcactcccaatcattttacttcttgctaatttgtcttttaaatgctagagttacattattttctttgtggatactggatagaaggagtatattttttggggagggaaaaggagggagtacattgtgactaggagcttggaaaattcaaccaatccaaacttttggtacacaagtactcctactacataccctaacggtagggtagctagtaactgtgccttgtaaatcgacacaacctcgttccagactagctagcctgtactgtgcgctgacagaaaattttggcaatcgacacgcacgcctctcgcacgataagttgtttgcataccatatgacaatgttcaaatgatcaaatcaatctattcgcatcatcgcatgtgaaattatgaatcgcataggagtatgaaattacgaatgcagtgaattaacttgggtgtgtgtccggccacgcctagctagaaatcaattcgatctttcgtaccacacaactacaactaggctgtgtttagttcacaccaaaattagggtccctttgaatcgcaggattgaaaaaacgtaggaataggaaaaacgtaggattttggtaggaatgtaagtgtaaaacagaggattgcaaaacgcaggaaaaacacatgaatgaccgtttgattgaaccgcaggaaaaacgcaggaattagatgagagagatagactcaaaggaaagttagcaagaggttgaagctcttgctaaatttcctccaaaatctctataggattgtccattccataggaatttcaaaggattggataggattcaatcatttgtttcaaagggcttcataggaaatttttctataggattgaaatcctctaaaattcctatgtttttcctccaattcaaaggggcccttagaagtttggttgaaattgaaacgatgtgacgtaaaagttaaaagtttatgtgtgtagaaaagttttgatgtgatgaaaaagttaaaagtttgatgaattattttggatctaaacacggaccgtgtacatatccacagggaggataacaaccgacgagacgatcgatacagagatgcttatctccacgagtactcctacgacttttcctcctgctgctgcattactacttttcctcttgcttctgcagctgcaatcgcatgcacactagtacagccgagacatttgacaagacgtagagagagaaacctagctagagagaaagagagagagactcaatggaacagtggaacccaagaacaacccctatgttgcgagttcccaatggaacagtaaaaccagagcaagaaaccctcccaacttgccattggaaaagatgctcctaattaagatctgacaaaaataacttgccattggaaaaggcactgcagcctagtatatgtgcttgtgcaatatgagaattaagatgcaatatgcgtactagtagtactatatgccatgttcttgtgcagatctggaggggtctcatctacttcactctgaaaattgcatgcactaatgaaagagctagagagacaagcatggaagagatcagcttagagatatctagcatgcagctctagcctacaaatggaagcaagcatggagagattgcatgcttgattctgttgacagagtactagtctctatggcaactgcaaaccgtaaagaggaattaggggacggcaaacacacacagatcggcagccatcaggtgactagaacggctgtcctgtctctctttctttaaccaaaacaacaacaggaacaggttagttaatcagctatgagcatgtatatgatcacgatcgaggtggtaaaaattaactaaaatcaggatctttgagaaagattggtaaaaattccaacaaatacaaacgaaatgctggtatatatatgttttaaacacaaacaaagcagcagggaaaagactgggtgtaagaacttcccggacaaacatgagatgttaattaaacacacggactgatgattaattagaacatggtagctaggtgggcagtagctagcccagaaatcacaaggagcttcaaaaactcataacgagaaaactagtctttcttggctgcaaactaattaactaactttgcattagaattagggcgagatatatatgaattctctgcaaggggcgagagcttgcaagagagaattattagtagtaccaggaggaggtggagaactcgaagaggcggccgcgggtggagaagatgatgagggcgacctcggcgtcgcagagcacggacagctcgtacgccttcttcagcagcccgttcctcctcttcgcgaacgtcacctgccggcttatcttgttctcgatccgctttcagctctactttccctcgccccatcgatctctctctagctctctctcggkctcaamatcwctcttgatctatmwcctmactctccttgcctagctagttagctgcagcctgcaagcttccctctctctccc

SEQ ID NO: 501 - DNA, 170371 bp, Oryza sativa
  misc_feature (1)..(170371): P0681F10 (OsMADS5)
tcacggagcgcgacggtgcctggcctgaagcggtgcggcttcttcacgccgccggtggccggagctgacttgcacgttgccttggtcgccagctgcttcctcgagtccctgacttgcacgccgtctgcttcgtgcgggtctgtgtctaacttattatacgtcaacaaaaccaatcgtatgcttctagatctaatttaattcgatttttataaatcaattaaggatttaagattttacgccgtgttcggaaggagggaaccctccccggaaaggctaatgggcgggtgatcgctcccccacccgcctagcgatcacccgcccaccctctcccctatactactagatgtactcctccctcttcccccttcctcatctccttctcctctttcagtagaccacacaaaattttttgaaaaacaaaagttagaaaaatttatgtatagaaatactatatataaaaaatttgaattcaaattcaaatttgaatcgggtatgtaaacttttgacttataaactttggatctataaactttagatgtatagaaatactatatatagaaaatatttgaattcaaatttaaatttgaatcagatataattaaaattcaaatttgaatcgggtatataaactttaggtctataaactttacatgtatagaaatactatatatgaaaaatatctcaattcaaattcaaatttgaatcggatatttgaattcaaattcaaatttgaaacgggtatataaacttttgacttataaactttaggtctataaactttagatctataaactttaggtgtataaactttatatgtatagaaatgctatatataaaaaatatttgaattcaaattaaattttgaatcggatatataaacttttgacttataaacttttggtctctaaactttatatgtgtaaactttaggtgcataaactttaggtgtataaatttactaaaataggaaagtaatgcgatgccaaaaaaggaaaccaggtggagggagggagtggggagcgaatctgatcgctaccccatccccacggcgatcaatcgcccattaggggtaccccctccctcctggcacgcaaaacaaaactcgttttgttgcatgattaattaaatattaattatttttttttataagatagattaatattattttttaaaatattttttatatagaaaattttttatatatcattataaaaaacgtgcgcgtgaaaaacgagaaaggcaagttggaaaaatggtgataaagaacaaagctttaatgatgaataaactcgacgtaaaatatacgggccagtaatttacaactgtattgggctgattacagacctaacaggatcttatggtgtatttggataatgggaaatgagaggtgggattgggattgaaatataaataaagagttaggattaaatggaagagggagaatgaatggttaagatttaaagatggcttttggtgggagggaaatcatttccataacccattagccaaacaaggccttaatgtgaagggtaaatttgctacaggacactcaaagattgtggtctttgctgtgagacacccgaagatcgtgtatttgctcgtgaacactgtaaaaaagtggtaattagctgctggacattcttcccattattttattatttccggtcaagatggagagagaaagagttgtgtaagtaccaaaatgcccctggacactgttcttcctctctctatctttttttccccttcttcttccttgcagcagagcagaggtgcgagtgtgcgacggcggctggcccgagcttggacggctcagccacggcgaggcggcggcggggcggtgtaggccccacatcctttctttttctcttctttctctcctctctcgagcaggcgtggtggcagacttgcgtgaggcggccggcggcggagcagggggcgcggcgctggagagagggagagagacggccgacgcgatggcgagctcggcggcggagagtagcggcgcgcggcacggcagcgggggagagggggcgcgcgcaccgcccgtcctccatagcgatggcgtgtagcacgttcttgtcctccagcgacgccggcgtgccgacgtcggaccacaaccaggccacgttcttcttgtcccggaagtccagcaggatgatgaaggaggtgtctgtccgtaggaacatggtcgctgccatgagcgtgctcgtgccgtcgagccactggagcttgtcggcgtcgccgagtgcacagcccggcggctcgtagaagaagtcggcctgctcgccggtggtgcagtcccagacgccgatgccacctatagctgactgaggtcttatgatcattgtgacaggatgcaccctgcatccttaaaccgtgacagcctctgcaaagccaacctcatacacactttgctgctcattgctgatcgatcacatgatgcatgatatggccattcatgtagagaagaatccggacaagaataactactagtggatcatggtgcagttgcagagattggggaggaagaagaacactcaatgaatgtcccttgttgcccgagacgcggccgattcgcgcctgccatctccagttgtacacgcgcgatgcggaagaggtggcgcgggtcgccgggaaggcagttatacacgcgcaggtcgccgccgctcctccatcgctcatttgtacacgcgcacagcgctgccgtgcgcgacgcagcagccgccgttgggcgcggcgcggacagccgtcccgtcgcccgcggcgttccctgccatggacgccgccagatgcagctggtccccgtcgaacggcccccaccgtgcctcgcggaagcggtcgaggaggccgtaagagagcgaggtagagcgcctcgcgccccccggcaaaaccttcgcgttgctgtcgaagaagaacagagaaagagagattgacaagtgggccatggacaaacttgtctttaacttaagtttctctctccgttttcatcgaaaataataaaataatgggaggagtgtccagtagctaattaccatttttttaccgtgtctacaaacaaatacacgatctttgggtgtctcacagcaaagaccacaatctttaagtcctgtagcaaattttgtctaatgtgaaagacacagggaatatcaaacctggtctacaggtatccgtcggctgctcctggcccagctgcaggagcagcagccgccgccaccaaccaagctcgaaaatgctactaggcgcggccacgtagcatcgcgcggagagccggacggcagagcgacgcgtgttgatacggggtgggcagaaaaataccgatccaaaaagaccgagaccgagaccgagaaattcggtgatcaattcggtcctaggtagcgaaaaaccgaaatttgttcggtcaatttggttagtctcttcgggtaaccgaatagaccgaattatcaaaaaaaattgtcaaaatacaacctacaatccactatgtctaataggattaaactttaattttcacatccctacttcttctaggcatttaacctaataagagtctttacttataagtgcttacgaattttttttttatgatttttgtgttgaaaatttccattatttctttgcatatatgaaaatgttgttgaatttcggtcaggaccgagaccgaatttgtcggtcctgatattttttcgcggaaattcggtcttcacttttcaaagatcgaaaagaccgaaagaccgaaaccgagatcgaaattttcggttagactgaatgcccacccctacgtgttgagacttgtgagaggactggcgcggttttttttcgggtttccctcgttttttttctggtttttccgatatttctgcacgtatataaagtttgtatacgtattggtttttccatttttaatacgtatgaatatataaagtttatatatgcatgtacacaaaatttgtatatacatatatagaaactttgtatatgtatatagtaaaattttgttagtatacgtataaaataattatataaatatatatcatacatatacatatgtgtatatatacgtatgtactgtatattgtattgatgggttagatgggggcggaccgacaacgcggctggccggctgccggctgcagccccgcgcgcaaccgatcagccacccccaacaagctgggctccagtttggcgagtcaacgagcgaaatcaagtagtagacgagcaacagtggacgccagcaaataaaccttcacaatgtaccgtccaaatctcaaagccccgaacgttcgacgagcttcgggaaagctctatcgggcccttcatgtacaatgtaccgtccgaatctcaaagctccgaacgttcgacgagcttcgggaaagaacgaatcgttcgcaccggttataaatagtgtgctgcgaacgttcactctcacaaccagtcaaccacaaccatccgttcgattgatcgatccttccaaaccctagcttagtcgttgactcctgcgccgtccggtgagccagccatgtctcccgtacgcttcaacccgtggcgtgcggcggaggcggaggtgcaaggtgtgaagaggaaaggtgactcctgctacaacaaggggagctacgggaaggccatcaagcactacacccgcggcgccgaactcgaccccagcgacatctccttcttgatcaagcgagccaaagccctatcgggcctgggacaggtcagactcctttttctttccggcctgattgaacaagacaagggaaagggtaggggagttgtttagacggtgggattagtcgacggacttactagtaacatcttttagttcccatcccttgtttggtttaagatggagattaccccgggatttgggggagatttggcacaaaatgggcatctctggaacgtgaatcgagtggcacattctgaaacgagtgtgaattgagtagcatataatgaaatttcttccaaattgatgttcctcgcggatttaattttttttttcgagggaaccctcgcggacttgattaacgccctgttcgtttcagtaccaggagtgcgtgagggactgcaacgacgcgctgaggaggggcgaggagctcggctccggcagctccggcaacaagctgatctcggaggcgctgttgtggaaggcgtcggcgctggagcatctcgccgactgcgccgcggattacgagcaggtgatcctgctgctgcggcggtcgctggaaacgtgccacagcgaggaggcgcagattaggctgaagggggcgttgttcatgagggagcagtacgaggaactcaaaagtatggactttcatttcctctgctttatcagtatacgaagccagttgattactgtgcacattgatcgattttccttgtattttcaagatatattcctccctgacatatggtcattgaatgatctactacctccgacccataaaaaaaagaccagtactgaatgtaatatatcatagtactacgaaaatctctgtctagatttagatttattatgctagaatatgtcatatctaattatatatttgttttttttgagacggagggagtagataccactttacccaagttttactttaaaccatctttagcacatacagtagtattatttcacatcctttgagaactccgcaacaaatgttgtggttgttatagtggaagtgcagaacgcaaagtaaattgtatagctcatggggcttgcaatgccagtgtagttgtaccaatatgccctttctttaagcatgagtatatatgggtgtgtttagttcacgttaaaattggaagtttggttgaaatttgaacgatgtgacgagaaagttggaagtttgtgtgtgtagaaaagttttaatgtgatggaaaagttggaagtttaaataaatagtttagaactaaacaaggccatagtagcaagttcctgagccctacctagtactactaaagttctaaattggaattgcattaaattgtaatttatagtcattcttcctgtaacatctctaataattagaagttgtagcttctttaaagcagagttcggaatgaatttcgttattaaaaaaaagtcccattaagatgtacaaatgttacaggccaaaaacttgaatgtggtgcttatccaacttacacgcagcatctttaccccgcaaggtacctttccagtcatctgttatccttataaattttgctattattattggaactaacattttgtccggtttagacttgaagagcgcattaacatggataaaaccaggctcaacaccttgttgaaggtattctacccatttactttctttcttttaacagggatgtattgcttgtgtggttatctctaatgttgtaaaaatcagccaaagtggccacaaattcgggtaataccaatatagctcctcacaacttggaagatacaatctgtaccttcttatggaggaggtaccgaaactaattctacaagaggaaataggattgaagatttttgactctcattggtatttaagggttagttaacagataatggaaaaaacatatatacctcccgagtcccgatatctctcccaaccaaaaaaaaaacaaaccttatattgccgactatacaccttcccaaggttggaagcagtgggccaaaacggccttaggctattacgcattcttttctctttcattttaactcatttcgcatagcacatatatttttcctttttgagcacttctaatatggtggaatattatttatttttatcagcaagctaatggatgcctatttttagcatgcaacaaaagaactacaaaaaaatgaggacaaattatccgaggagcgctcaagacggaaggaatacgaagacatggtaaaaaccattaccgatttgctaaatgtcactgcattgaacatttatttttgcaaaagtttagcttgaccagaagcgtaacatcatgtcatcaatcatcctcaattgtttcttattgtgaaaaagtttgattctatagtgtataacagcattcactgctgctattccaagatatggacgagcttggagcagatcattcccatatcagaatacttttcgattacatttttttttccaaaaattgaaaactgtaggatgcagcgcgccattgagtacacctatcaataatcccgatgtatgtctgaatgatatgaatgtgtttggtttgtgcaggtcatggcaattcaagcctcgattgaacaacttacaatgaatcacgatgcagaacttaagtcagtccgggaggataaagcgaatctagaatgtcaactcttacaatgcacagagaaacttgaacggctacaatccatcttaaaccgcgaaccgccattcacctgtcctatatttctggtgagcagaaaatgatcattattttttccttttccagttcatcttattttttatatacaattttctgaaactattgactattgtacaaattgtttttttttccttcaggggattttcacccattcttgtcatccaaacaatcataaaaaatgatgagttaatatgaggagatggcaccttcacaaatgtgctggtttaaattcaacctatatcacttgaagccaaaacactatttatagtcatatttattatttttttcaactggccttgaatttaagcttaaatgtttgtgaatcaatgttacataatattctttcttgccaaaatttttaataacttttagatgtcatgcaaaacaaaatctttcctgactacacttattaccttgcttggtcaaaatttcagcatgtcatggaggatccttacattacagcggatggacacacctacgacggtgaggcgatcagggcatggctcgacgctgggcatgacacatctccagttaccaacttgcctcttgaacacatggaactcattcccaatcgcgcactccgttctgctattgtgtggtggcacgaacagcagaacgcggcacgcgaacaccgcgacatggcgtgaactacaactcggcgtttcatattgtaaaattcttaattgttgtctgtacttttgaacaattttttgctgtctgtagttacttgttagccatgtttataacacacaggttgaaattgtaggctgttagtatgccttgtacacacaggtcgatataattcatgccagaatgcaacataaacacagcattcagtaaaacagctcttaatcatatgactgtgaaacagtaccaaatatttcacaaaagcaggtgaaacaaatagcaagatttgaacatcagaaagatttcccatttataatcagagcaacaattgacagcaacagcaacaagccattacatcactactactaagcaattctggtactagagctatcacagatgaagcgactaataaattaatcaggcgcgctcaccgcggatgcggcgggcgagctggatgtccttgggcatgatggtgacgcgcttggcgtggatggcgcacaggttagtgtcctcgaagagcccgacgaggtacgcctccgcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcccggcctgaagcggtgcggcttcttcacgccgccggtggccggcgccgacttgcgcgccgccttggtcgccagctgcttcctcggcgccttcccgccggtggacttgcgcgccgtctgcttcgtgcgggccatcgaggaggagaggagaggagagcttgacgcggcggagctttggatttgagaaatttcgcggcgaagtcggcggcggcggagtgggttgagacagcgagggaggcgacgcgtttatatagggggaggctggggtttggaatttgagagcgcgaaaattttttgggtttggattttggccgcggggaatcagcgccgttggattgcgtgcgaatggacggtgcagattggatccagggggcatcacacggatcgcgatccgtggggggtcgagttctgcgctgtgattggttggagcagctgcgcgcggatcgcgttcgcatcccgcgcggggccgcgcctcccccaaattccaaacccccaaaatttcgcccaaatttcgaacattttcactgcgcgcgtactatgcgaatgcgaatccctcccaaatttcacgcctatttaaacaccgccgaatcccaccgcctcaatccaccaccgccaagtttcaaatccaaagaactcactcgccgccgcctccgccgcgccaagctctcctctcctccttctcgatggcccgcacgaagcagacggcgcgcaagtccaccggcgggaaggcgccgaggaaacagctggcgaccaaggcggcgcgcaagtcggcgccggccaccggcggcgtgaagaagccgcaccgcttcaggccgggcaccgtcgcgctccgtgagatccgcaagtaccagaagagcacggagctgctcatccgcaagctccccttccagcgcctcgtccgcgagatcgcccaggacttcaagaccgacctccgcttccagagctccgccgtcgccgccctgcaggaggccgcggaggcgtacctcgtcgggctgttcgaggacaccaacctgtgcgccatccacgccaagcgcgtcaccatcatgcccaaggacatccagctcgcgcgccggatccgcggcgagcgcgcttaggccatcagcccacctttggttcttgcttgattcatagggacttgtcatgttctaccagttggtgttattattagatcgtcgctttgtcatgtcgtagtcttagattcttagtttccatggttgcaatgtaactgctggttattctgaaattgcaatcgaagtaatctgttttatccccaaatttctgtgtccatcttgatcctgtgaacagattgcctttgactggatgatgtgatgttcagaatgtttctgaagttattctgatgatctgaactgaatatttcggttatcctagtacttgtcctgttctgtttgatattcagaaatcaaaatggttctgaagttttccgattgctggtatggatttgcagcatttgtccccaagattggaagtagtagtgtttttctcaaaaggaaaagcattgaaaagaattgcagttcaagtctctgttatattcatacataaaggcaagtactctatacttctgtagtctgtttcataatgctcaaaatctgcaattcaagtctcggtaccgtagtactgtgtattagtaggatatacaataaacatgattttattcttagttgaaggtttgaatatcaaacctctttatgtactactgactactgagactttcatactatttacaacatctcttttccagaagatgtgctttcctgtcatattctggtttcagcaactaagtatgactagattggtgctgtgattatgctatgggctgtaggtggcaaagtttggaaagatcaaaaggtggatatgaatatgagccgctcatcaaggaagatgctatgatcttgtttgcagcttctgtcgcatggattccatcccagctcacgtagttctgtggatcagcacaagcttttgcggttaccgtttggccattcagcaatttgctgcttccacagtacacatctgggttgaaattgtaagccccatcaccatatccgcagcaagccttagtcccatacttcagccctgaaaccatggtcaatcagatcagtatcacaacaattgctgacaataagcaagattgattcatgtaatacttgaaactgcataatgtaccactactagagagcatataccatgagctttaggatggcgaaacagctcgagcgtcacagcgtgtttgtcaagatacacaatagatgcatcctgcagcttcttcctaacctcggccaagctattgttcagcagttcattgtagtaggtcactgcactgttgtaggttttcatgcaaccatatccatccatgtcattgctggtatgcgggagtttcgtgaggaatgccgggtagcatccgataggcgccatgttaaacaccataatgttgcgagcgccaatgttgtacaattcctgcgaagaatcgaataggtgagtatggaatatgcagttaattattaatctccaatctcttatctttctcaagttcagctaaattctaatttgcactatttacctgcacagtagaggagatcttgctaacaactgaagggagactttgcttgaccgtctcaatgctctgtgatcccaggttggaggtgagatcattttgaccaatgtcaattgtgtacagagcattgtgcagaacatcaggtgcaggaagttggtctgaaaattaatcttaactagattagcaatactatctctgtcagtagcagataagattgttactacttgaaacaaaaccatcactgttcagatcaattatcctaaatattctcttcagaaattcagcagaatctctgcactgacgcagggcatgactgaactgtctgaaatctgaacaggataccatcactgttggcgttgggcgagcataccgttgttgccattggaggtgagcaccttggtcctcagctccttcatctggttgagctggacagcgaggaagaaggggctgatgccggtgacgaacagcgaggtgttgggctgcagcgccgtggacgccagcgtcgcgaagttggcgccgtggcggtagccggagccgacggactgcaggtaagggctcagcagcggaagccccatcgcttgcactgagacgaacacaccaccatttccttattcagatgagcaatccatggcgcggcgagcagaggaaggagaaggaatgaagaagacgtgcttgcctaggaagtcgacgacgaggcggccgtcggaggcgcggccggcggggcggcggaaataggtcataccgaacggcgcctgctgcgccgggaaggcggcccagaagccgccggtgtcggagttggagtcgccgaagttgaagacggccgggaacctgcactgcgccgtcgcactcgccgccgcgacgaggcagcacagcgccgcagccgccgtcgcgagccacgtgatcctcctcatggcggagagagagagaagagcagatagctcgtaagcttcgatcggcgataggcgggagacggcgcgacatgccgtcgttttatagcgggagagaggaaggagatgggagatcgtggtgttgggctggaaatgtaattttcttttttcttttcttttcttttttccctttttctgagagaaattgagacggcattgcaacgattttgttttcttttaatgagagaaattgagacagcattgcaacgatttcgttatgggggagagaaggagatggggatggattgtggtgtttgttcttgttcatgctcgttgttgctgtccagtgatgcaaagctcatcctcagcagaaaaaagatagcgtggtgaacagtgatcctcgattctagatcaaacgataagttcttcaatgacatttaggccttagtgtgtggatggaacagtcaccggccgacacatattctggacttgtctgcagcaccacagtacatatgcttgtttcatacggagtatgcccaaaccagtgctttaggcatgcaaaaaggtgcactacctccgtccaaaaataagtgtagtcatgagttttcgcactcaattttgatcattcgtcttatttgaattttttttataattagcatttttgttgttctgagatgataaaatatgaacagtattttacttatgacttatgttttaaattatttttaaaaaaaatttaaataagatgaacggttaaagttgggcgtggaaaactatggctgcatttattttgggactgaggtagtaattgttagcgtgtttacttaccatctggaagttgttcgtcacgttattgaacgagtgattttgccaccatgtcaagtgacaaccaaccgtcatccacggacatgaactatccagtagtgagctccagccagcaaattgccacaggaatctggctgctgctgtgcagcacacagcgttcggagcttactgaacaacggcgggaagaaattgctgaatcgaccaaaaaggagtagcaaacgtatagcaaccaaagtttcagcaatcagaatcatcacctactggctctatatatccgacacaaaaagcaaggttaagtttatgaaaccgcttgggaagcacaacaatagtcagttcatgaaactcgtagcggaaatacgcgtacaatagctagcactcgaaaccatcattaaaaacgcgacatgtatggcgcttgccagcgtaagatggacctatacatgggggaatatgtggagagttttgttctggactatgatgtgccgatcaggtgctggataactttgtcagggtcgttgtcgtggatggccagcagttcgggaacatttgaggatgtgaagcccatctcgtggagagcgttgtaggatttcacaaactccttcacctgcaagtacataggattcatccttgtcagtttctctctcttttttttccactgtctacaaatgctcgtggcgattagaatggcagaagacacttctatctccctgagaagtagaaaatcgaattccacaaaaactaccaactggacagaatggcaatcactgttttgctagaagaagaaaccctagtgcttctgcaaatactgattgtatatagctatcttgttgacctttgaaaacctttttgagttatcaaagcaatggtttttgttcttgatgatatgttgaaagaaggtaatgataaatcacaagataaataagggaaaaagcatgccttcgctggattatctccatagttcaacacagcaaatgagacagcttcacgtccaagccccatggatatatacttgtccacaactggatcccctggagtagcctgcagaagggcaaaaataaaaataagttttctagggagatggcattacatctctacaacttcctagggtacctaacttgttataaacagctgatattgctatcatgtgaaaggatgccaagaagcgaaaaatctcttgagtatcaggggtattagtccccatttgcccaaggaactttatatattagcccttgcaatggattatcgatttttcaacaacagcctgctccctgatgttaagtacctagcactatttgtgtaatacacaatactatatggaagacaagaattatgtagatattattaccacagaagtagtgggagttgtgagttttgggcctcttggcggctgtggtggtggtggtggctgactctctatcacaaacttgctccagttggggttctccttctcagcctcagcaagaattttcctttcatactcaaaatcaaaattgaaggtactgcgaggaatttctgtaagctgtggcggcaactgaggctgcaataataaaagcaaagcacacattagaggatggccaatgatcaaatatacgagggaagtgtagataataaacgttgatgcatttaacaaagaaggatgcataaatatgcaaaatagatggaagtttgcaagatgatgccatttgtctctagaaagaacagctaggcaagcgcagtacatggaacaagttttgagggagcccattatagtatgaatcatgtctgcaagctaccaactagaacaccatattcacagtaaaagaatggaatggccaataaatgaataaataaataaaggaaaagaacaaacagaatccatccacaaagtctactatacggaataaactgcactatctatatcttctacgatgggcttctaacaacataatagtccatcaagaaacaactagaccattaagatttgtgagcgttcagaacataatagccccatgcagattgaataactagaggtgaatcctgagctaatgctactagaagtccattatttgtgaatatttgtagtggagctatttcctcatctctaattttacgcacagaagcacaaaccaatatacagagagacagtttataaacaaccatatctcctgttacactgcaacataatatcttcgttccttttcaaaagccaaaggaggataatttcagcagttcaaaactatcatgacgctatgatttatgtctgctttcaatacacaaaagttagaaggcatcaatttgaatctgaaagaacagtgtttggctgtttgctaaataaacaccaagttactccaattgaattaccaatcttaactaaacataaagggaatttataccaaacatcctgcaggcattaaaatagaaaatttggtaccaaagcagatgaacaattctcatgtaggtgaatacagcaaagtgatgactgaataacaaacttagtgacttacaggaggggttatccgatatgctggctttatcacaacttgtatgcccactgcagcaacaacaattaatgatgaataacatgctcttgataattggcaaaaaaggaaacgctacagggcagtttctaaatctggcatgatatcaacagtaaaaacagggatgttccaatatttttgtcttcaaataacttttgggaaaaaaattatatcgatgggcccagggaattctacaattttaccaacttcggctatgttgaaaacaccattaaaacaaacacttcaatgttttcactcccacagtcaatgtttcattagcaaaggtgcagaaagaaccctatgctgttgcatttatttgtctttggctagtgaaaaaacgcacacatgcaaaagccagattttctcgcacactttaaaatatagaaagtacagcattttcaactaaacaaagctgttacttttgagaactcaattttgtacataacgagaccatgtttaggcctatactgaggtcaactagaacatataaacagtagtagagctcgttcccttatccaaagacaaggtttaatctaattctgttgttgttgctgatacaagtgcccggtacgtcccctttttcattgctagctaggaagcatagcatggtgaactaactaatcacaccgatgtgcaaatgattaaatcgaggcaatttactgcatgaacaagcttggtaggtctgacaagccacctagaaaccaaatggtagtagaagttcaatgcacaactcaaaaccaaactagctcagtttcagggataaatcgctcgggatcacgatacccctccaaccggattacaacatgagatctgccaatctagcacgcaatccaatcaggtagaataagctgttcacaattcgatcgagtaaacatgacacgcagttctctcttctgcgctacccagcgattcactatgcagagattcagtatgcacagagcggggagggagggatttactcgatgtggaggacgaggcggggacggggtgcggagccgcggagacggtgggggggccatggtggtggtacggcgcggcccgcggcggctccggcgggggcgcgttggcgacgccgtgggagggctggccgacgcgcgggtagagggacgacgaccccccgccgccgccgacgccgccgccgtaggatccggagcccggcctgccccggtagtcgtagtccatcctcgccgcgcgcgcgcgcgcccgcgccggtggggctgagctcctcgggtgagagctgacgcgcctcgccgccggtggatcgcttcgccgggaaggatggaggaggacgcggttgcgggtgggggagaattggagcggagaggtggacggagtcgccatggtcggggaaggaagaaggcaacgtgatgggccggatcacgaggcgggctgggctggggttgtgctcgcgtggacgccgcttcggcccgcatcgaccgggctttgcggtgggtgggtctcggcctgcctgtgcgtcgagggtgggccatgtagggagggtgggccgcgtgatccgaagttgacgaccacggtaggaataagttcagtttaactccctcagatatatctccaatctaattcatatatctaaaccgctactggatatcttgaatcaacaaactattagaattggtgtaatttgactccttcaaggtttaggagggtcgctaatgtggcactttgatttggtctaaccttttgagtcatcctatgggacccaaccatcagtaacccttatatttcttctcttcctttccttttcccttcgtcggatcggcgccgccccctcttcccccttctgctctgcgctggaccgccattagagatttttatgggttttagggtgctgttgtagcacgaaggggcaaattttaattcttttgccacttgtcgtcgtggagggggttgtctgtaaatatgttgcctacgtggaatgccacgtcagcggttagctccagtcaagtgaggtttggactggctacgaatcattaaaccaagatgacagatctatatgtgtaatttttaagtttacggacctaagtgacagctactttcaagtttaaagacagtcatgtattttacttaaaaaaaatagcacttattcaattgctccaatgtcatgatatgtgagcaaatgggtgcttgcatttacggttaattatttttttattgataggtgatatacatgtcggcagcaaagacgttcgtagtgatttcatcatcttcaaaatatatcggtcaagtttttataaggtacttacagtatacgcgcgttatgaacgtccgtatttgtattcgtatagtgtgtttctaaaataatagtaagagtggaaacataatcgaacagaccaagtggcgaattaatcatgtctatcctatcaatggatgcatgcatgcactcttccgttaaattagcgtgcaactggcgatggcgatggcgaccgagtctggccagtctagttaatttctctctctactatactcaacttatacagatgcttacaaataatgcaattatgtatcaggtggagtggcaacggcgctcgatcgatggccttcgattcccatttctatggctggcgtttttgtccgttgcgttggctgcagcgcaggggatcggcatgggtcgtccggccaccgtaccggccgggctaccggctcgtttcgccccgcgcgcggctcgatcggcatctctggatcgttgcatgtcaccgtgcgcgcgctggcgttttgcgttgtccggtcaggcgcgctaggcctagctatatatcgatcgcgcatgcaggcttcagattgcccgggtttcactccctttctctcccagatacgcagatagttagatcacagttgttacatactcccctacatgagggtggcggatctgtcatgggggcgatagagcctcgagtactcactaccgatgttacaaccatgagagttttcattaagtttccactaaaaatttttatcatacatatattagattattagaataatgagttatagttttttataacttgttcagccctttctatgagttcttcttggatgcaagcctttgcagttttcatcccataaaaaaaaatctaagtagggagtgtagttcgagatgtgataatcttattactaggatgcatcacatctagtttgtttttattaccatccatattagtagtattgtgattgtcatatcctgtactagatttattttttataggatgaaataagtagatggagtagatcgtttggaacgttcctgtttaattgattcagttatagctaataagacatagaaatataaataaatgaccatacaaatagtttgtaggtaaacttgcatgcatgtttcattaatttgtagttatggttaaaaaaaactcatgtcggaaaatacaccacttatacggtaaaagatatctcgcaatcaactctatatttgaatttcaaattttaatttttggctctgttacgttactaacatgtttacgatttctagttttttgtaaaaaaaaaaactgtgcgaaatttattcgttcatcttttttccatgaagtgtgtcggctctatatctcgatacaagttgaaagcaaaatgccaacagttttcttctgttttatttctttaaagagatgccaaaaagtagatatttggcgtataccttctgttcccaagcgtatctaaactaaaacatgatgcgtttaatttgtccgtgctccttcaaacatgtcgctgtacgttggcgattttggcacgttgcgtttgagaggggaaaaagaaacaaatttgggcgtccattaggcggctaatcattctgctgcttttgtgattatgtcaatagacatacatatatagggagtgattgattggtttgctcgtcctgttatgtcttgatctcgtcatagcgaagaactctgctgattccttttagacctttggccggccattattagattaatttctcacatcaattaatcgtgtgtgttaattttatgctgaatggctaaatagataaataatttatactaataactattgagagcacaagcatgtgaattaactattataaagttgtaaatgtatttaaatcaatattataggaaattcaaaattcatatataaaaacccgttcaaaaatcgtttagaagcttcttgcatgttcatccgttttcacgtttcacagttttcacatcattaccttctctttcttcaagtcttatgaagctgctatatagagttatatataaggcaagtttgcatagctctgatctaaatccaatatatttagaactagatattcatagctccagaaatacatttttatggatatgtcattaaattgataatgtttgaaaaaaaccattttattcctatttcagattaaattccttaaaaaatataaaaaacaaaatattgtaacttaacttacaaactctacatcagcgtgatctaaagctgtgacaaacaaaatatctaacttgttttcggaatcaatttgttcttcaaacctctattcagggtcaatatagcagaagaaaagggtagattcttttatgattaggagtggttgaggagcgcgccgtttttacggatttgcttataaactgatgatttaacagctgtaaaatgtactcaactgttgcatggtcaaccgcgcgagcgagactgcgcacgtgacgtccgcatgggcccacacgtcggtgagtcatttgccgagaggcggtgtcgcgtggcgggagtgcgatcagctgtgccgcttacacgtggccgaagagattaaagatgagcactttgtttttttctaaaaaaaaggttaaagaatatttactgatccaaacaaccaattaaaataagggaatttaactatttgacacttttaagatggataattaagaatctgtcacccgcaatatataacatgcggaccaatatgtgagtccttaattatcacttgtaaaattgacaaaaagttaaatatctctacaatgcaatatatgacatgcggaccaatatgtgagtccttaattatccttgataaaaagttaaatatctcaaaaatagaacccaaacaatgggtgaaagaagatctaaaggatagatggtatcaagtcaaaatgagagggagacaacagtctatatacgtacatatgtaacaaatcatgagtgattaggaggttgaagattttgcaaggatccagatactataaaaattcctccttgcaattcttgagccttaagaatctcttcgtatagcttcgttctctctccctcccttttctctcgcactgcaactactaccgtatcgattgatcagtctcctctccttcatctccattaatttgcttgcaactactaccgtatcgatcgatcagtctccacctctccttcatctccattaatttgcttgttgagagcttgagatcaagcccaatggtggaagttatcgtggagaagaaggcgcgaaggattgtgagggggaggtggcatgtggaggcgagcaacgaagcggcggcggcggcgccggctgttgccgcgcccgcgcccagggttgttcgggttctctgcagagaccacgacgccacggactcctccggcgacgacgatggcgaggacgacgcgccgcggcgtgctcgcctcctcgtgcacgagatccacgtcgcgcggcagccggtggccatgtcgccagcggcggcgagctccagccagagacgtcgtgtcggcccgatgaagaggacggaatcggcggtggatgcgacgatggacgcgacggcggcggcgccggagaggaagttccgcggggtgaggaagcggccgtgggggaagtacggggcggagatccgcgtgtcgcagcagagcgcgcgcgtgtggctcggcacgttcgacaccgccgaggaggccgcgcgggtgtacgaccacgccgccctccgcctgcgcgggccgtccgccacgaccaacttccccatgacgccagcggcgccgtcgcctcctccctcgcgcgccacctacgccggcgcggcgtccgggtacgacgagtccagcgacgagtcgcagctcgtcggctcgccggtctccgtgctccgcccaatgccggcgcgcgcaacggccaagaaagaggccaaggaagaagacgactccgcccccgatatcctcggcatctccgccggcgacggcttaatctccccgttcacctgcgacgtcctgaatttcccaccgcccgacgaggacatgttcggcggcggcatctccttcggcgagccgacaccgccacccatggtgttcgacgacgactgcatggcgcgcctcggccacgcccccaacgacgacgagcacccggtgacgagctcgtccttcctcgacggcgatctcggcgacctgccgtcgtggacggaggtggacggcttcttcagcgacgtcggcggcgacgacctgttcgccgccgagccgttcccggcgctctgagactgacagttttgtcgcgagctttgtctacgtacgtacgtgtgcttgtgtagtgtgtgtttaattaattcgtttattattagcgattgcaaatatttcttgtgtcaccgtgagatcaccggagatcgccgagggaatacaaatatttcttgcaaatatatatcaccggagatcgccgggggaaatgcaaatatttcttgcaaatatatatcaccggagatcgccgggaatgcaaatatctctttgcaaatatatagcggcggagatcgctggcaatgccaccggtgacggcagcaaaccggcgtaatatagaagacgcgccggcgtaatatagaagacgctgccgatattatctaaccttcggatcccatgcataaaaagtgcatctggcgggttcggagataaaaatatccgactccttttgggcttttttcctttttatgttttctttttctatggttggaccatgtttcccgcttggttctccgtgcccagtgtagctaacgggccgatgtaattgtgccgtccaatgattttagacccaacgtgcaccgtgcgaaatagaataagttcactttggatctctgatcttgacaccaaattccacttggtgctatcagtctgtttctacagtggcaccgactaggacaagaaattgggctagattaaaagcccataatttacacggacacgaaagttttggcccatgttgatgaataaggtggaatcgaaccctttcgaattatttttcatagttttcaaattaggaggattcggagattaaaacatcggccctcttcattatttttttctaccttttgccatcatggcctgataactttgggacaactttggttaatcgactcgaatattacggacgcaacaatcgttttaatatatcagcaggcttatacttgaaaaaaatcagcaattgcaagcacatacgtaattaagctcgtattaattggcttgtaatttacaaattttcccttgttttcctcaagttttgcccttttttgctgtcatcgtaatttacaagtattacgccttgcaaatgcacatgaacgaatgaatgggtcgacgaattttacaagttattaattgatgattgttgtttgattaaattcaccacgcttcttcctagtggcgacaatagcggcgacggaggctgtgacgaccgacgacgcgacgatgatggcagtgtttagtgtgtagtgtgtgtttgatttattcatttattattagcgattgcaaatattcttgtgtcaccgtgagatcgctgggggaaagcaaatagttcttgcaaatgtatatcatcggagatcgccgggaatgcaaatatatatcgccaggggaatgcaaatatttcttgcaaatatatagcggcagagatcgccggcaatgccgccgatgattgcggcgagccggcgtaatagagcagtatcttatctcagacgccgccgacattatcgcgtgaagacatggaagtatcgagcagttagatacttagatcgctggatcgcataaaaaaaacatctgcggggttcggagataaaaacttcgacccccatttggacctttttctttttcttttaatttcctttttctcatcatgttggattggcagtgcggtgattttagacccagtgtgcaacgtccaaaatccacttggtgctattaggccgtatccatagtggaaccaaccaagcctagaaattgggctagattaaaagcccatagtttacacagacacggaagttttggcccatgttgatgactaaggtggaatcgaaccctttcgaattatttttcttggttttcaaattaggagggttcggagattaaaacatcgatgctcttcagtatttttttctaccttttgccatcacggcctaataactttgggacaactttggttaatcggctcgaatattacggacgcaacaatcgttttaatatattagcaggcttatacttgaaaaaaaatcagcaattgcaagcacatacgtaattaagctcgtattaattggcatgtaatttacaaattttcccttgttttcctcaagttttgcccctttttttgcggtcatcgtaatttaaaagtattacgccttacaaatgcacatgaacgaatgaatgggtcgacgaattttgcaagttattaattgatgattgttgtttgattaaattcaccacgcttcttcgtagtggccacaatggcggcgacggaggctgtgacgaccgacgacgcgacgatgatggtagtgtgtagtgtgtgtttgatttattcgtttattattagcgattgcaaatatttcttgtgtcaccgtgagatcgttgggggagtgcaaatatttcttgcaaatgtatatcaccggagatcgccgggaatggaaatatatatcgccggaggaatgcaaatatttcttgcaaatatatagcggcagagatcgccggcaatgccgccgatgattgcggcgagccagcgtaatatagcagtatcttatctcagacgccgtcgacattatcgcgtgaagacatggatgtatcgagcagttagatacttagatcgccggatcacatgcaaaaaaaaaagcatctgcggggttcggagataaaaacttcgaccccccatttggacctttttccttttcttttaatttcgtttttctcatcaggttggatcggcagtgcggtgattttagtcccagtgtgcaacatccaaaatccactcggtgctatcaggccatatccatagtggaaccgaccaagcctagaaattgggctagattaaaagcccatagtttacacggacacggaagttttggcccatattgatgactaaggtggaatcgaaccctttcgaattatttttcttggttttcaaattaggagggtttggagattaaaacatcgaccctcttcagtatattttttctacctttttccataacggcctaataactctgggacaactttggttaatcggctcgaatattatggacgcaacaatcgttttaatatatcagcaagcttatacttgaaaaaaatcggcaattgcaagcacatacgtaattaagctcgtattaattggcttgtaatttacaatttttcccttgttttcctcattttttcccttttttgcggtcatcgtaatttacaagtattacgccaaatgcacatgaatgaatgaatgggtcgacgaattttacaagttattaattgatgattgttgtttgattaaatttttcacgtttcttcctagtggcgacaatggcggcgacggaggttgtgacgacggacgacatgacgatgatggcagtgtgtagtgtgtgtttgatttattcgtttattattagcgattgcaaatatttcttgagttaccgtgagatcgctgggggaatgcaaatatttcttgcaaatgtatatcaccggagattgccgggaatgcaaatatatatcgccgggggaatgcaaatatttcttgcaaatatataacggcagagatcgtcggcaatgccgccgatgattgcggcgagccggcgtaatatagtagtatcttatctcagacgtcaccgacactatcgtgtaaagacatggaagtatcgagcagttagatacttagatcgtcggatctcatgcaaaaaaaagcatctgcggggttcggagataaaaactccgacccccgtttggacccctttttttcttttaatttcctttttctcattaggttggatcggcagtgcggtgattttagtcccagtgtgcaacgtccaaaatccactcggtgctatcaggccgtatccatagtggaaccgaccaagcctagaaattgggctagattaaaatcccatagtttacgcggacacgaaagttttggcccatgttgatgactaaggtggaatcaaaccctttcgaattatttttcttggttttcaaattaggatggttcggatattaaaacgtcgaccctctttagtatttttttctacctttagccatcacggtctaataactttgggacaactttggttaatcggctcgaatattatggacgcaacaatcattttaatatatatgcaggcttatacttgaaatgaaaatcaacaactgcaagcacatacgtagttaagctcgtattaactggcttgtaatttacaaattttcccttgttttcctcaagttttgccttcttttggagaataaaatggaattttaggtcatcgtaatttacaactattacgccttacaaaggcaaatgaacgaataaatggatccacagattttacaaggtattaattgatgattgatgtttgattaaattcacccacgcttcttcctggtgtcgacaatgatgacgatgatggcggcgacgaccgacgacgatggtggtgtgtagtgtgtgtttgattaatttgtttattatttgcgattgcaaatatttcttgtgtcaccgtgagatcactgggggaatgcaaatagttcttgcaaatatatatcaccagagatcgtcgggactgcaaatatttcttccaaatatatatagctggagttcgccgatggaatgcaaatatttcttgcaaatatatagtggcggagatcgctggcaattccgctgataatggcggcgagccggcataatatagcagtatcttatctcagacgccgccgacattatcgtgcgaaggcgtggaactatcgagcagttagatcaccgaatcgcgtgcaaaaaaaatgcatctatggaatctccgaacccccatttgaacctttttctttttcttttagtttccttttctcatcaggttggatcgaacgtgaggtgattttagacccagcagtgtgcaacgtccaaaatccactcggtgctatcaggccgtatccacagtggaaccgaccaggcctagaaattaggctagattaaaagcctataatttacgcggacacggaagttttggcccatgttaatgagtaaggtggaatcgaacccttttgaattatttttcttggttttgaaattaggagggtttggagattatggggctgtttggatgctatactaagtttgtcaccattcaccatacatttataccacacttgcctaagttgtggctttaaaaaagaaatccacactttgttgagttgatgacgtgtagggtcataatatatgagaaggagttttgccacaagtatggctatgaaccaaataatagactaactttgtcaaacttgcctaatataaagtgtggcaacctatggcaaactttgggagcaaaccaaacaacccctaaaacaccgaccctcttcagtattttttttctaccttttggcatcacgtcttaataactttgggacaactttggttaatcggctcgaatattatggacgcaacaatcgttgtaatacatcagtaggcttatactttaaaaaacagcaactgcaagcacataggtaattaagctagtattaattggcttgtaatttacaaattttcccttgtttttctcaagttttgcctttttttgcgggagaataaatggtattttaggtcattataatttacaagtattacgccttacaatggcagatgaacgaatggatggatccaggaattttacaagttattaatagatttgttgtttgattaaattcacccacgcttcttcctggtggcgacaatggcgacgacggaggcggcgacgaccgacgaggcggcgacgatggcggggcggtagcggacgaagaagttgttcatccgcttctcgtggaacaccttcaccttctcgacctgcacgtccatggccatgaacaccgacgggtaggtggcgtacccgtcgatcttcttgatgagctcgtgcacctcgccggcgcccctggacccgccgcgcacgacgccggcgcggcggaggatcctcacgtcggcgacctcctcgacgagctcgttcatcagttggaagtagcgggtcaccggcttgctctgctcctccagctcccgcgccaggaggttcctcgccaccgtggccagcttgaagtcgaacaccagcgccggcagccgcagcgtcgcggcgtcctccttgaactggaccacggcgcggccgtcctccacgccggcctcgagacggacgcccgagcggcggagctccttcgccgtcgggatcctcgacgtcttgccgcctttcacccctcccgcgccgccgccggcttccgacgacggcggaacaaggctggcgtgcaggcagtccaggagcgtgagctcgccggagatggcggcgtcgtcgggtttcttggcctgttcgtccttggagaagaacggcgagtagtacgagcagaacgagcggatcacgccgtcgaaattcgcgcgcgcgaatccgagcttgtattcccggagcgccttcgcgacgtcgtccttgagccccgggatgtcgccggcggcggcgtggaccgccgcctcggcgaggtcggccacggcgagcaggtgcttgatcgggagctggttctcgagcttgatcacgtccgtgacgatgtcctgcatgtgcgtcgccttgaagctctcgtcgacggcgtcacgcctggcggcggccgcggcggcgcccttgccgccgccagtcgccgccgccttggtgagccgcgggaggaagccgacgacgaggaagatggcgtcgatgacctgcttgttctcctccgtgccttcgtcgggatgctgcgtcctcttcgccagctgatcatcctccgctttcttcttatcctcgtctgacacataatattcgagtaaattttgtcaaattgctccaaccaactacaacgctcttgggttcgtttgaactccattaaaacacttccttcgtttcaattacaagtcgtattattttttttctaattatcagcatttacaatactgaattagtcccattaaaactaacatttaatatgcttgttttatattgaaaatattgctataatttttataagcttgatcagaacgactttaatatataacgccgttgatttattgataaacgtttaaccatttatcttatttaattttttttgtaaatataaaaaaattatgtcatgcttaaagaacttgacgataaatcaaatcgcaattaaataaatgataattacataattttttttaataagacaaatcgtcaaatttatcttaaaaagttaacgtcagcaataaaataggagttaaagtatataagaaataagattgaatgtgatatttactacttcctcagtttcacaatgtaagttattttagcatttcccacattcatattgatgctaatgaatctagatagatatatatatatttagatttattaatatcaatatgaatgtgaaaatgctataatgacttatattgtgaaacgaaggaagtagtacggactatctatccagattcatatctaaagtagtgaaaaaactaaagtttttcatcatctcagtgcgccacatcatcaattaaatacagaccatccgatggaagaaagattcattttgaaccgttggatctggagtgtgtctgaggctcagtaaaattctattgtcgcttccatctcacgttcaagcaaagaagcacaggcttcaggaagcttcgcccatcttcctgtcactcccgtacttgccatatgtgatcagtgatcggttggttaagcagacaaggatgagtctcctctgatgtaaagtcagaggaactttgtcactgacatgtgggagtgacaaagtccctctgactttacgtcagaggagcgcgatccagcagacaaatagtctacttatatgatgtgtgttaatatgcatatgtaaaagtgtagcaagtcttcttttaagcatttttgttaagtactttctctgtcctatattaagattatttttagctcatcccatttatctcaaaataaattgatttttagtaataattatatcaaagtttataaaagtaaagaataattgcattggaagtagataaagtgataaatagttatattaggatgagataaagtagggatattttagtcttttgatgtttgtattggtatgtgtaggatgagtgaacaataaacttattttggaacatctgtattactaatatgcatttgtactaatttttttaccaggtatgcatatgtacaaattactccctttattttaaaatgtattgagatatatataaatataattaccttctcaaacaaactttccaatattatacttttaactactactgttttctttcgtttattatcaatacctacaaaatcgacgccatataaaaatagtcaaataaaaatctaacaatactactttattatataatgatataaaaatcaaataaaaagtcataacattaatcacatatccaaacctgtacttttaatccattcattagacaagtttttatgttttgatttttctcaaaataaaaatgccttatatattttagaatagacgaagaaaaaagttagtattcctttatcatacaataatactctattgtcataaatatataacgtttgttttttcttgagcaatctttcaaaattttttccatcaaggagatctcaacaacagggcaccgttggactgacctatatatacacatattttaaacgggtcttaatagccacacaacgcgtggcttatgtggctagttaatagtagaaaatgttttattcagttatatgtccttatattttgggacgacgtaagtatttaacaagcctctgaccttctgaaagggcctgcggtctacgtggtgaagggtcggggtggacgtgggggcagcagtaggcggcgaggttgaggaggaggtcgcgggagaggtgcctggtgtggtcgtcgacgtggtcgccggtgacggactcgtagacgagcgccgccttgacccagaagctgttgccgcggtcgatctcgttctcgaggccggcgtgcgagaggaggaccctcctcggcatgaactccgacgggttctctgcacgcatccgcgtgtacgccgccgaccccagcatccccgccgccgccgtccacgccgccatggctttgctcgtgcgtgcgtgctctggttcgatgggtggtggtggtggtggtgatggtgagtttgattgcgtggtggatgggagggaggagtatttatagcggtgtcgtggatgtggggggcgatgggcttgcagtaatccctttcgtgacgtggttacttaactggagggcagctgacgtgacaggggagaagaggaatgtaggagtactagccaatggctcctacagtagtactagcagcaataggcacgttgctgcattgcattccgccaacttttcttcagaacaagatgagtagtgattgatacacccccattccaaaataagcttatttatagttttttttaaccgtttaactatccgtcttatttataattatttttataattattattattattattattattagatgattaatttatttcttttaattttttgtatttttttaaataagacatacggttaaacgttgaataaagaaatccataaataaacttataacttattttatgacgaaaggtgtagtcaaagaagatcaactagagaagtaaggtaaagtattaggaaatgttttttttttcttccatgtgagcatttgtaatggactattggactgtgtcccttcctctcacaattactcatttttgttttacaaaaattgcattgaagacatttttccttcccaacttaatgtccatcattttggttcgtgtgttcgaggctttgagcaatgttctctaccttggtcccagattttaacacttctctaaatatatttttctgaaccaattataaataatgtttcatctacttccttttctcaaacaattataatatttttcattcaattttaccgttatcttgatacacgtgtctaaccccataattttataggaagaaataaatgagcagctaaaaaaacagtataaaaattagtggcgaaaaacaaaatattatcctaagatcacaaaatcccttatacattttaggacaaactaaaaaagacagaatgtcaaataccttatattgcgcgacggactgatgtacagatgtagtatttgtttctatcttgcggtcgatccgttgatggctcatgaatcatttctctctctttttcgaaggacgggaatctgggttggtcactcacaaagatgaaggattgataccttaatgagatgcctggacgtctaggtatggagcactggaggctcttctctatgccattaggccatattgcccttacagcaggttaatgagataacaaggggtaggtgatcacggcatcacgccaaggataattggataaagcaacttgatttgattacaaggggtggaaaaatgtgctgcatatgcgagtgcctgtgcctgctaacacaaggcacacctgactgatgccgcatgcttccaaacactactccctccatttcacaatataaatcattctagcattttccatagaatgacttacattgtgaaacgaaggaagtatttagtcttcaccttgtgatttccaagatctcttttgacacttgacatcgcagtagctacagcttccaaacactatttagtcttcaccttaagactcaacaatacagttacctaatggactaaaatttatcttcacacaaatataagaacagcacaggcgacaaagtattaagcaaaaaagggtacaactgtaattgatgggagctaaatcctattgattccaagactcacatttcgatgcattgagaggttgcttgcgtggtatcagccacatgtgaaaccgcttcaagcatcctcatcttattcttcactactcacaagtgccattcatctgaacctgactctgcatatggtcactggaaccatattggccaagtagcaggcctacaagggtaaccttgagtgatcgtttgcaactttgcataactggttccctttccatgtagtgtacaaagttttcattccgctcatgaaagacaggaagattgagggtcctcggagaaattcgctgcttccttcaaatccatttacatgacatatggttgatccatgaaggcccattcgaagatctgttcatactgtgaggcggcatggtcccatgtaaagtcgcttgacatgcctcgcttcattagaccctcccaagaggacttgtgttccctgtatgtcgaaattgccatccgcaatgcctgcaagaaacgatgcaaatttttagtacatactccaaaagttcatatggtgtaatgcttgtgccctgaaaataccattttcaatgaggcttttattactgattctacaatgttttctcaacaaagtttgtagctttccctaattattatcttgactacttgagtacaaggcaaaacaaaactgactagtactcacattaaattgtagacaagcaatgcaaatctttccttgtcaaatccatttttttatcagtttcatttgaagtgttcaatgacacaaaatgggccctgtttccctgtttccacattcgaagtatgtaccaaacatgcaattcaaatcatggactggtcagtcgagcaatttagcaacctaagcacatatatgcttcagggttctattccccactaattccagtttcccattaacccaccaagtgctgagccgctttcttctttggatttcaatcacgtgtgttccttttctttagtttgcttgtcaactctttcttataatatttacttaaatctgaaaactaacaagtactaggagttcaatcctactggaataccagacaataaccagaactggctggaacatacgtcatgagcctcaccttgttttatcctttttacttctggcaagaatcaaactacattatgattaccggcaagaaaaatagcagtatacgatacaaccaaaatgcatagttgaaatcatcatgctattgatgttaagagggccaatagtattgatgttgtatggcatatataatgggattaaggaatggatagaagaactaaaactaggtgcaggttcaacataaacttacccacagcattttttcaatggttagtggcgagaatgcccacctgcaatatgtcccaagtagcaacagttaaattaattggttataaattgaataatatacaaaaaaaaattgaatttaattaattccactaaaataaaataaatctgcaattttactttaatgaagcattccttaccctgtaccctgctctcctttctcagcaaacgggttaaaattctccactgtatcctgttgaataaataaaaaaaagtgagcagctctgccttgggtgctgtgctgacataagtgtcacactataggaaagcttactctgaggcctccagttccatgaacaacaggcactgtaccatattgcatagcatatagctgattgaggccacaaggttcgaatctggatggcatcaacaatatatcgcaactgtacaaaaatagaggcatcaatatttcaaatgtaactttatcagcaaaattaattgagatttcaaatgtaaatgcatccttagctgacaaatgactattattggcgaagttattttgcataccctgcagttattcggtgggaaactggaacactaaatccaacccatccacgaaatttatccctgtaccctgattctgtggatctcatccatccttcaaaacctgggtcaccagatccaagcatgacctataacaaaaaaaacaaaaggtgtcattttttttaagaaaaaaagaagtattaaaaggtgtcattgatcaatcgatttcagttgttggctaaaatatgtggataaaattttttaaaacccactacaaacactactctgttttagtctccagttgaaagccagaaacccccaacaatgaagtatttgggataagcacgtggttgcagttcatcaagacatttgctgcctacaagttagatcctactgacttaataaatggtgatccttttgtctgcatgtatacgcgtcccctggtgtctgtcagaagatgttgtttagtgtacccaaaatgtataaagggtggaaataacagactggctggccaagcaggtgctccaattgatatcacactggatggttgctaataagtcatacagtggtcaagttatactactgctatctttcttttatgacttgcatatgcattttttcttatagcactaatatttgcatctgaaatactagtttacttgcatatgcgttcacaatgaaagcaatagctgcatattacattccttagattcatgataacaagctatataagtgtcaatatactactatatacactaagatctatcacattcactttctagtctcacgcagaaaaagaaaacagaacttacgaattgaatattgtcccgcatgagatctggaatggcaagtttaattagatcaatgcctttttgatagtccaatcttccaataaagccaatctgtaaataaagctaataaatccaactgcccataaaagaatactaaaataaataatttcataaatatttgtatctaaccagaggcacatcgggccttataggtaaacccagctccttctgcaattcagctttacacttggcctaaacatgaattcgaggtttcataaattagtctgtgaaagaaacgacgaggtgcaaagaaaaaaatgaaacgagatgacaatctgtatatacatggtactatacttcacctttccggacaggtcatcaacagaataatgataagggagaaacttgtctgtggatgggttccaatcattaatgtcaattccatttacaattcctacatatccagggaatagattgaattaatttgtatcatccaccctattacaatgatcagtccaagaacaaaatataaaaacccaaatataggtaccattcaatacactcttccgggagcttaagagctcattgaggccttgcccaccttcagcagttgtgacctcccatgaatacccctggtaatgaaacataaatgattccttaattgagtgcaagacaaaatgaacgaagaatttgcggtttaaaagccaaggcataaaaatagactaggatgggaaaaaaaaatcaactctaaggttaagttcaaatttcaaattttgactgtggccgtaagccaactagtagacgaaaaggaaggaatctcacctggctgacagtcacaattcgatctgctgtcacaactgcgccttttaaaaaattgactgcctcacccttgtcaagggcatgccgccttgcccactctggaaacacccattctaatgctccataccattcaggtggcaatcccaggtcaggatatgtactggcaggctccacaccctatcacattgaaacacaatgaaatactaacatactgcacttacaaagtgccattacaaaactacttaaaagatatgcaaaatgataggctcaaacctgatgtgctagattatgtatgacaagaacactgcgggcatccctgtaaacaccatatggtctatattttgcagcaagaaggctggataaacaagataaaagttatatttaaattgatatgtaaggaaaaccaatttaacattcagcattgaagtaaaaagggactaaaaaataagtgtgatgagtttttcactggcattagtatcttatccaccgtgaggaacatgccaaaacaaaggagtagcaatgtagcatctgatggatcaaaccatattcataatatgcagcgaaagacattacaccattaacctcatgttgttctgaagtgtcttagaagttagaaagcatgtaccacgcactctcttaataattataacatcaaattatggtgtgaaacaagcagtttaaatttaccacaaattagagggttgcaaactatcacctcagtcacctagtagcatgataggccatttagactacaggatttttcccaaatcctttgggtattgaattgtatctgtagaagatgaactcaaaataggcactaccataataagaaacttcgcactagctcagaaatattccaaaaaaaacataggcagggagattttcagatcagctatgaactagtgtagcacaaaactaaatcatttaaacacataaatgatgtactggactgttcatgtttttggaaatatcaaaatgattgagaaaataatgaaatgaatcgcagttctcctgcgcttttgagaaaaaaaatgattgagaaaatcctcctattcactcaatctaatattttgttcctcttatctaacatagacacacacaaacacaaagcaaacgtatgaaaaaaatggtttataagagatattcaatgttaatcaatttggttgcagagtttcagatccagaacatacactggcacaagactggcatgccaatcattcacaacaaacatgcatttctgtccatagatatatcctcccagttcaagaattaatggggcttcacacgccgcatagcacaggagtgtgtatctgaactgcagtatatagggaagtcaagtcgaatcaatgactcaatgtgatataatttagactggtcaaataggatcttgatgtaagaatacctgattatcgccaaaagcaccaaaattatctccatacaaatttccaggtctatgatatgagggatgatcaacaaacacctgaacaggagaagtgaggtgtaacaaaaaaataagtacccaaaatgcaggtatgctttctacaatcagcatgttgtgtcatgggtgatggtgctgcggagtgaacactaccaagttccaataggaataagtaaacatttggtaaactcaacaaggaatcaatcttgcaaccaaaaatgctagaaatgtttcctcctaggttatacacatccttgttccttaatgattatcatgtcatgccatctacatctattaccagttgtgacaatacatgtttcaatgtaacccacatgttcactttcaagaaataaaaatgcgattgaagtacataattcccatgatataactacaatgttactgatgactattaatgcaatggaaaagccaaacagtacaacttattaatattaagtgcttgttgcaaacagaagtcacaaatgcttgagacataaaatggatacattaagtcatatgaaggaatcttttgcattttgatctggaaacaccagacatcaaccagtgcacaagtgtatagacagtaagacatagaaacagagtacagaatatgatatgatcatgtcttcagtgggataagaacaaaaaagataagcagatagttgttttcatcagaaaatagtaaggagattgaatactcacccaatcaacagaatccctatactcgtgaaaaaaagtaacttcatgttctccgccaaagcatggaatcttaatgtgcttctcagtgtaaaatgcgtttgcaaaatttttgttcaaggccccgttcatgtatctcggcattacaaccatcacacgatgaccacgaagagcaagagcaattggcagtgaaccacaaacatctcctagtccacctgactttgcataaggagaagcttcaccggttacaaagacaacgctgcgtgttactttagcttgagcttgctccttcacatccatgatctcagactcctgctcactagccacaaaaattgttttgtcgatggaatcttctgtgagacctgaatgcaaaataaaagatattcatatggtatagtattggccgagaggcccaagaaaaatacagcagaaacataaataattatcgttttctagccacatcttggcatggcagtacagcagtaatgggagcattacaataatgcaaacaacattctgatctgaataacgccaaattcaggttgtcattgctcccttctgccctctaaataattggattttagagaggtgaggtgaggtgagagtacgtcatataatcaggaaacacatattggtggcagcccagagaatccaacagatagcgaggtgggtctagtgataggaaaagcacatattggtcccaggcgcccatgtgattgtctaggtacacatggaccgtccacagaaaatggcgccatcgaccacaattcagtgcaacgaaaattacgaaatgctactgtcactctacagaaaattcagttgacggctgagaattgaactcccaacttgagtatcgcatatactccgtacttgcctaaggaaaagacaaagtcgtcaatttactcagtttccaacgcttcctacaccaaacctcaccattcctcttcccactaaattacgatatcaaatactactacatcaatggcgtgtctgctcaaacccagccacgtgcacaggcctcgaaacctcccaggtgcccaccccatcgccacccccatcatatcgcgatccaataaatatatatattgtgtatatgtgcagtataaaaattgttagtgatgtgctcgaattggggttccaatttctcgcgtggtaattaatccgcagggtttgttcgattaatcaagtgatcaaaggcgcgcatggaactgcacggatcgggcattgatacgggaggagagggaggatcagcacgagacaagccacgtaccttctagatcgggctcgatctcccccacgccggagtccggcaacggcggcggggtcggcgccggcgccggcgactgcgtgggcgcgggtggcgtcgacgtcggcacgaggaaggtcggcaggaccggctgcttcaccagcggcgccggtgccagcgggcgctgcgccgacccaccgtccctgctcagctccgccacgcaccgcctccgcacccgctggagccgcaacctcctccccggcctcacctgcggcgccaccaggcacgccgccccgatccccatccccgccgccgtcgccatgatcccccctcctctccgccgatcctgctgctgctgtgtcgggcgggccgcgcttggcgggcggtggtggtggtggtggtggtggtggagagagaggagtgggctgagtcgcggagacgatgagagagagagaagaggtgggtgtgtgggtttggttttaagcgagggagaggcgctgaggcggtggggcacagcaaaaacggatcgcggggtggatgagctggttcgctctcgctacgcgcgtggcgtgcgcgcgcgtcccaccgcttccgttccttctctccgttgcttcacgctaaacgaagaaatgtcatttcgccatttgcatttcacttcacaaattcaatttttataaatcacaatggaaaaataaattaaactacaactaatccttttttaaaaaagggtattatttatccgatatgtacatctaaccggatatatataattgtttaaattgaaaatttagctctcaaataactcaatctaaaattcgttcaaatggagatttgaacgtacgatcttgaggcgctaatcaggttaatacatgttctttcgcaaactataactaattaacgtatattcaaaattatttttttttattttttttgtaaaatgtagaaagttaaatttgatcatgcaatgttatgggtttgtgaagtgatatattacatcataaactatattattgaatttttttaaaaaagtttataatgacatctatacctaataaaaaaattcgtaaggtttccgtatggttttttcgtccgtcatccgaatcagaatcatgttgctaaaattgttttaatccgctcaatagtcgggatggatccttttggatctacctcaaaactaggttaatataggatatgtattaattgatgtaacatgtgatcacaagtagcagcttgcctacttggttagtgaagaaaatcttcattgtggccaccagggttcgttcccgccaccctcacctttttactcttattattacaggctttggcccatttaagtttctctcctacctattgattcatttttctttatttgtttttttttcgcttttttcttgggaaaaaaattcctcccgacgctttatctttttttttccttttttatgcggtaagttaggataataacaggtagggaattcactaaaaacaaagttcaatagaaaaaacacataaataatttagttaaaacttttaaaagaatagttgaaaatttcaaatatgtagttgaaagttttcgaaattcgagttgaagtttcgaaatcttaagtgaaagtattcaattttggtatagcttatttttttataactttttaattattaaagtaatttttaatttttagtaaaaaagagaagaagtaaagtagatggtaatactggaaactaattacgtaaaaggaaaaaaagaggtgcgaaaacagaaaagaggagacacggtagcaaccaactgtgcgaatttttttttcaatttttatccgactccttgcgcaagaggtgcgaaaaaatagagaagacaatgtggcaaccaactgcgtgaaaaagaagtctcgaaacaaaagataatataaaaaaaggaaaataggtcgcacgcgactgtgcgatggatgggctcaaaacgcgcaccacttaaattcgcgacgcgtatgcactaattaggagttttgtattattactcgcactgtctatgggcctctcctaggccagattgacctaccctacctaaaacttttacacttattattactcggaataagtctactttgtctccatatctcaaatcctatttgcgtgcaatttttttctctccgccactagcacggaccatgcacatcctttttttttctctccaccattagcacagaccatgcacattcgatggctgaaaagtcaaaagttttatacctctttcttcaacagatatttagtgattctgaaatcttataatgaaccagtttttaatttgaaaattaaacataatttttttttcttttcgtcatctgcaaaacacgacatattagagtccgcaccatctatcgtccacgcatgagctgttaagcgattcgtctccacgcgaatccgtgttggattttagaagtaatatcatgcgcgtgccatgcaagagttgagagagagcttgtgttatgacaatatgagtactatatcaatatgcaatggtgtttcttattagtcttgattatcattaacccaatgaacaatttatctatcttgaaatattattacatacatgttaaccgtgtatttatagcatttaaccttccattatacccgtagcgaagcacgggcattttgctagtgtaaatttacatatggaggcaggtgatgtccacttgatcgctttggcccgttggtttcacggtttttcaccgagtcaccggggactcgtgactcgtgtcgtgtcgtgaccccgctttacgtggcgcgttgccggatcgcgagggcgtcctctgcgtttctctctctctctctttcttttttgtttgggcttggttgtgttgggacgtgtacggtgtgtcctgtgttctgtgtgtgggctgtgtggcctttttgtcagcttgttgagataggttgtcaaaaactgagatagactttgcttgattgccttgtttttgcttttgccagcttgtttcagctgggttaacgtgattgttctagctagattttttgcagggggtgaagtgctgtgttgcactaatgatacagtggttacaaaagctgtgcacagattacaggtagtaccattggccatgagtgagagtttggttcatttgtatttttcttggaagccagcatgcagaggcctaaactatctgttgtttggctttaattagactacttaggaaatattacaatcgcatattcgcatatcaaccagctgtgaaggtgtttgttgctaatccttcattcattcatattcccagtttaatacgtgagatagaagaaccgaagtctcacgcattactctaaccggagtttaaattaattaagctttacttattttagtattcaaataagtgccaaatacttatccgcatgtaaagtttatttcattcacattagtaaatgtcgtcattgtcaagtgcttgtgacaatcatcttgtaactcaatcacgcaagtaattttactattagatcatgaactattgagttgcatgcaccgtacgtctccctcacgcgaggccccctcaagtctctagcgtggaataaaagtatgctgaaatttttatttaattgcacgccagccagaattcgaactcgagacatttagctctgatactatattaagttgcatgcatcgaccagtttaacccaaaagcttaagctgatgagtaaagacgggcaatttactttatattccaacatggaccgtacgtttaattgatatatcgagcacgatcaataatcaacaatgccacatttcggtcttgtttagttccaaactttttcttcaaacttccaactttcccatcacatcaaaactttcttacacacgtaaactttcagctttccatcacatcatttcaatttcaaccaaaatttcgatattggtgtgaactaaacacacccttcattgcatggtagagtatgtaattgaaaaaagaaactactcctggctaaattaaatcgacagcgatgggttacatatatcctaattacatactctaccggctgatcgtccgcgactggtgagttgggccacagccaatggcaccggagttgtcgtcggcgccacgacgacgagtaccaccatcgccgccggcggcgggcgtagctgctcgcaccgagtcgatcatcgtcttgatgacagcctgcgcggggaggatgacggtcaccctgtcctcccggagctcgcggatcttgtcggagagctcggcggcggtgtacgggcaccggtcgttgtcgatggcgtcgatcagggccaggatgtaggccttgttgccggcgatcgacttcttgttgctggcgacgagctcagagatccaggtgagccgcatcgccatcgcctgcctctcgtccatcgtggccagcttctctctcatcctcatctcgtcctcttccatggctggctaagctctggctgctcgtggcttctgcctgctaggctgctagagtacgtgcgtgcgtacgcgtggacgatgagtacgttgaggactcttgctgctgctgatgccgccgcgatgagaaaagtagacagccaggggtctggttatataggcaggcaggcacgcggtgaggcgacgaggcagtcgacgattcggagcgcggagtccgtgtcggaaccgaaaagagctcggcacggattatgttgggctcgatctgtctaggatgtactgggctaaggcccgacgcccgtatccgggccgccgtcaggggttagaattttgaaaaagtatatactccctccatattttaatatataacgccgttgactttttaaacaacgtttgaccacatgtcttattcaaattttttatgcaaatataaaaatacgtatgtcatgcttaaagaatatttgatgataaatcaagtcacaataaaataaattataattacataaattttttgaataagacgaaaggtcaaacgtttgttaaaaagtcaacggcgtcatacattaaaatacggaaggagtacgaggttccttatcttgtcatccctcgactaacaaatccgggttagtctgtgttcctttgaaggggttgggaatccctcccctccgcacgtaaaacggagcgatagattaaaacatgattaattatgtgttagctgtaaaaaaaaacttttaaaatagattaatatgattttttaaagcaacttttatatataaactttttgaaaaacacgcaccttaaggttgtcagtatcccgattcgtattcgaatatcttacgatactacgatcctatcaagccgaaacgataccgatcacacatagaatcctaattttcataatatctcgatcctactattcattactacacgatccaacgaaatcttaggtagtatcccgatgttagggttacagataaggcataccttctatcctacgacttatggaatatacgaatatggtataccttcacgtatacggatcgttcccgtgtacgtggtagaaatccgttccaaattatggaaattatctctacgagtcaagcgatgtccaaagtcctactcggaaatgtatagagtttctgttataccgtaccagatcaaatatcctcgaatctttcttaggggtcaatacgatccacggtataaaagggaccctcaaggaggggtgtgaggacatccaattccatcgccaacacacccaccatagtttacgaagccggagtgcgcggagccaagtcgccgggagatctcgtcgaactcatcgactacgatcttatcggtatcatccgtttcgtctattctctttgtaatctgttctcaccatcatcaatctcatataaactggactatggctattacctgataaggggcttgagccagtataatccttgtcttttgtctgcttgatgttgtactacgtagacccctgctccaacgtaccccaatactcaactcatctggtccgcgagtatcactcgtcgacacccgattctacgatccctacgacactacaaaatattatttaaaataacatggtttgaaaataatgtaaataaatatgctcaaatttatataaaaatcagttaaatatatcaaaaccaacgtggtttttctttgataaatgtctctatttgcatgacatatatcattactacatttattttatatagaatggctatatataattaatataaatattaattaaacttaaaaaagaaaatctcatattattccgatactacgatacgatattactttaaacaaaacgatactacctagtatctcgatcctgacaaccttggataagttaggaactaggaggattcttagacggttttaactcggttttatctgatatagcagctgagtcagcgtggaacccacatatcaggaagaccacatcatcaccctctttctcctcttctctcccttcctcctctctctcactctcctctgggcaagtgaagtctgccgcccggcggggcgaggcggaactcctccatggtggtgcgcggaggtggaggcagggcggagcgctgcggcggcgaatgcagggctccggctgcactccgccgatttctcgccggagccgggccggagcatggcggtgggcacggacagtggcggatccagaaaatcgattcgttggtgtcataacgtgtctatcggtgtcatagtatgctaattatgtttagatcatagtgttataacatatggataaacagttttgctataggttttgccgaaagtcgtcggtgtcgcctgacaccgggtctagtactgtagatccgcccctgggcacggaggcggaggcggaggcggggtcaggcgccgtggtggttggcgcggaggccggcgccacggaggtgaagacgggcgagagcatacaggcgggcgccacggcgacggaggcggggctccggcggaactccgccgtcgagacggtggctttccaccgtgctcacggcctctgcaaccgccgcctccgcttctcgcgcgttgttgtcgttgccgccgccgcctcctctctccttcctctgttctccttcctcctctctccttcctctgttctcgatttctatgtgggctcgaagggaaggctccttatgcatatacggtgttcgatgaaatgtttatcaggtatgatttgctgttttcatcgcattttcgccgcccttttgaggatcaatggatcatcagatgataatgacatgatctacactacatcgcagagaaatgatcggcgccctcgacgtcggccggttgatggatcgatgggctcgggcagcccgtggcgtttgtggccggcgcagttgcagacgaacaggaggacgcctgacagacacagcctctctggagtgatgacctcattgagcagaacgaggccccacctggtcagtgggacgaccaggacgcctctgccgtcgggcggtgacgtcattgcgcaggatgaggccccacctgtcagcgagcaggaggctcgtgcaccttttaaagtgctcgccttggcgctcgcccagagccccaagccgtaaccgactaaccgtcgagctcctcctacctgcgtctcgcgccgccaagaaacccaagatcatcccaccgcgcccccgtctccgcctccgcctccacctccgccgctgctcgccggagcccggaagcgatggagcagttccacgacagggaccacgtgcggctgcggagccgcgtgcacggcacgtacctccacgccgatgaggacgggaggggcgtctccctgcagccgaccggggcatcgctcaccgcggtttggacggtgcacctggagggcggtagcccccagcgccgcctcctgctccacagcgccgcctacggccgataccttgcggccacaggcaagccggggccgagcggcctccgtggccaccgtgtcgcgcttatcaacctcgaccggctggacgacgagtccgtgtcgtgggaggcggttcggacggcgaaaggagatgacgtgctgctccggcacgccacggggcgcaacctacgcgccaaccatggcgctggcgccaccgttgacgatagatacagcaggatgctgctctgggtggaccaggtggttgaggccatcccctcggcagattccgtacccaggcctccaccgatctcaagggtgagcacgctacaccctcttccatggtacatcccgaattggttgggggcaggggagcgattctttagcccattactgcgttacctaggttcttgcagccaagctccatttctggttgtattcttgcgtcagagttagcgcattagcagagtttcatcaattgcattgttcttgatgaaatccttgttgtgttcttgctagatttcgtcctttgttgttaatcatttgcaatgagtttgtggcggtgagattttttgtgcaattttggcttagggggtagattgagttcatggaagtggttgttggttccatctgtagttcttttggtcgaggtgctgaaaatgtgtaacattcttgttcttttaggaacttcttgaaaacactttcattttctgttcttgtgttatccaaatcctactaattttcagagttcataggcaggttggcatcacataaccgttgctgttcgtgttgtcttgcattggattcttcaacgtatatcctgttctctctatctcaactaatttgcggcgaatctgtttcagcgccaggacgggcctgagataagaaccatccggtttgtgccagcagctcctaatgggaccattgccgaggattggagaacctttcaatttactggaagatcagttcagcggttaaaggaagagattacaagccgtgctggggaggcaacccagtactgtgttcaagcaggccggtacggacgtcttatccctttgacacatgagcttcctcacaacactgagaccattgatatcatcattatgatgactggtactacaggtgaggagtttcccttttttattttcatgttctcctcgtatttttggtgaaagaggctcgcttgaatttgttgcactgagctaggtcaatagatattattgctgctcttactttttagttgtgcatgatgtcttaagtttgattctagtcagcaaagtgttataatcttctgcttgaacagatagtccttgtctggttagaaaaatatataaaaatctcattctatagattatatgctcaaggtagtttatacagtattgaattttgttgcgcacttgcgcacattgcactgagctaggcaagtagatacagttgctctaccatccatgcatatttgttcataatattattttagttaagtgtaatcatgtgcaaacgtatgcttataaatacaggcatttctatataccagataataacaatcagtattacattgcagatccccacatggataatagcccaagaacacaactttctgctcctgagtccttgggagaacatcgtgttgctgacattcagacatcatactcgcaccgtctgcatacaaacaatgtacttgagagtcagcaacggaaaacaggtataacacgagctgaacttgaattgaaaactaggaatatccactggggagatttgaatttggaggaaaagaagaggacaagaaaggagttgaaagcagaatacaatgaactcttagctgcagaaaattgcatcagtaaatcgcaggaagatgatgtaattacaaacgaaaattatgaaagagcgtcactccgggatccatgagtccgaggtaaggagacaggagtagaacctgaaatcttcagaattttttcgctccctcaggttccaaaaataagtagctattcagagtttggcttgttgattttcaatctgcgtaaagttgctaaaatatggcctgaagctaattttatgattgggaacaatgacttgttagttgcatgcacactcatgctaaatcctaacatgaaaaatactagttttatattccagtcttcagttaagaaaattgagttgcttcttttattttcatgtccagaccatctgtcagctccttttcagtctaagaaatagtgttagattaaggcagtcttacatgcattgcacatactttaaatataaatagttcacttgtactgctgtattgtatcatacaaataaacaatagacaactccattgccattaaatcatgacaacggcttcagtatgctggtttctagatgagttatccctgttgattttagataatttatgaatattgaacggcttgtgagttgtagtgcctgtaattaacttgtctttaatttcttgtttgatcattgcaaattcagctgctgatggtctgacgagatagaagtcacagaactacaatagcagaacctctgacatcatctcttcagtaattttcgtatcttcagatcaaatgacagagattggatgtcttcttgttgttcttttttgttgatataggcttagaaagggaaaccataaactcttctttgctctgaagtttacagaactgttgtaaacaccaagtactagaatgtatgcatgaacaactgtgcgttctggcatttgctgtagtttcctactttccttggatatctgtatataatatgattgatcataaatttgcggtgtggaatgttatgctctatttttgacaactgaaatgttatgatcaagtctgaatacaaggcaactctttcataacctgttcctgtatttttatacagatgggcggttttgatttccccccttcttgtctgtggcaatatatccatgtaacgaagaacaaagtggcaaatcctttgccacctcacctctccggagtggcaaaaagttaaatatgccatttgctgtagtgctctgaacttcaacttctgaagcaagtaagcagaatgcctgaacaattttgtgctgtgacaatcttttgtcgggaatacacaaaagatatgcgtattattgaattacatttttgtgatgtgctgtgacatttgctatagtctccattttatctgtatgataggaccgaccatccatacatctgctgaagtgaatttttaatgccaattgtaaatgcatgaggtaactctttcataacctggtcctgtgttgtcattcagaatcaggtctgttgtgttaacatgcacagagaaaagaagggttagtaatctcggactgtccgacattagcttttcggtacaaaattgtctccccagaactacttttttttaaaaaaaaaaactctaacattatacatcaaaccttacagaacaattcgatactacctggaaatgaggcattccatgcttcttttttttaaaaaaaagaaataaaacaaaacagaacaactcctaaatcctaattacatgatcgcgagcaccatgggacgaagcgcgggtgaggatggctcgcacgtcgtcgagcatctccttgatcccgtccagcgcggcgtcgacggcccttgactcgcggaggtcgcggatctcgtcttggagctcggcgaaggtgaaggggcatgtgccgtcgtcgatggattcgagcaggtcacgcacgtagcctctgttgctggctatcaaccgctcggtgtccgcgaggaggtccgagatccaccccagctggatcgccaccgcctctctctcagcctcgttcatcatggccctatcttgaaatgaactagcagacgatgatgacgacgatgacaacgacgacgactcgcgctgagatggaacgaacgatgagacgcagcagctgagaccgggagttcggttatataataggcgccgtgcgcacaagcgacgaatcggaatggggagtccgcgtcggaatccgaaagagccgttgaatccgacacggattgtgttgggccgctttctgtaggatgtaacgggccgagtccggcgagactgggccggcacggcggataggaatgcagatgggttcaaccggctccgatcatccgatggacttttggtccgccgacctcggtggctcgatcagaatgtttttttctttctgacatctagtgagaattcgttatttagttatcttctttacggttgctagctgttacttcattttttttcctagctgttgactaagagatagtctgatatgagctcttagttaataaatacttcatccatcccataatataaggcgcccatgcatttcaagatttcatcttcataatattttgactaacatttagtacaatatgaattgaattttacttactaaaaaattatatcattgaattgacatttaaatttattttcatatggttataattttgttactacaaactttattatatatgagaaattataagataaaaattagttttgtagaccgtgtcaagtttgactataccttgtattataggatatagggagtactcacttagtgactattctcctataataatagttgagacaacaattaaattttttaaaaatgttgagacaacaaaacttcttaatcattaattccccccaaaaatatattactcttctttccttttctctatcccgtgcaacaaaatatcatttaataaatgctaagattccccccaaaaaaatatattactcttctttccttttctctatcccgtgcaacaaaatatcatttaataaatgttaagagtcgcctatgagcttttgtaggtcatatttaaatgtagagcccatatagactcttagataatgcatgtttattaaagactatatccttacaatggtagagacaccaaagactctaaaccattaatccacaaatattatctttttattatggttcacacactcatgcaacaaagttttcattttatagaggctaagagtcgttaagcagttgttaaccgtagcaacaatgtctgtctcttcttgcttctctctcttccatctaaccaaattcaattgcatgttaacgtaaagagctcgttaataagaatcttgtacatgcccttgctgtgaagtttacaaactgctgaaatttcaaactactaagtagaatgtgcgcctgaacaattttatgttctgacatgcgctgttagtttcaatggttagttttttagttcgaatggttattgtgcatgataattgatgcaaaccgatcatccacccattccagaagcgaaatatacatatcgttcaaaaaagaagcgaaatatacatatgctcaattctccaattgtaaattaattcatcaggcattgcctgtgtacctttttcactcaaaactcaatttgtcccaacataagtacataggacttgaacccagaaagaaaaaagaaaatcaatccctggcattgaggtgggcccgcccctggacggctggatcagatcgacgggcagacatccaacggccttgattaaactggtcttttttttttgaaaggaaggcaagaaatttgccttatatattgatagagaaggaggattaaactggtcttgcccctgttctgccttacggacgactacggtgaagaccgtcccggactcccctgtccgttatccactccgattcgacgatgatggttcatcgtgtcgtacgccgcggcccaataaaaacagcatgtaaaaatgtaccatcaaaacgtgaaaagctgcagcagcagcaggaagaagaaaaaaagacgccggccgaatcgtcgacttggcgcgtgttccgccgattcgcaaaccccgctcacctgcaggctgcagcatcatccgcagttcccgtgtcgatgtcgacggcaggttcgtttactatcaccccaatccttcggtttttaaccagtacaattttgttttttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagctgaatatcttcgaattcgtacgagatatgttacatcgtgtatgtcttctcagactcatgacgttttccgccctacttctacaattactcgtgcttgtctatttgtccactcgtgacggacctatgtttttttttcttttgtcctgggtgtgctcacatagtcccaatcagagttattcatatacacaaacacactaaaagatcttaatttatcaaaagtacattaattacaaatagtgcaaataaagtcttacacacataacgtataaacaatgaaaacaaaatatatttgtgtatgctttttatagcaaatatggcttgattacatcatgattagtgattcatttctaatcttaggaaaagctatatgaaggtgctaatctttacacacttgatcctcctcatatttaccttactaaaaagaaaaatgctaagatttccatacaaaattcttggctacccatgtacttgaagtctagaatttacgtccccgaaatgtttatattgagtaccaaatttgaatcatataaatacttatatttagcaataattggagtaattgaataaataatgtaggtcaaaatttaggaaaaactcagtagtgtcatatacgctccccccccccggccattaccaaatagcatttgtagtattcaatttttttaatataaaataagcattttttttgggacaacgattcgccaagcattttcagccaataagatagaatttgtagcatccaatcttttatacaaaataagcattttgagaacaatgattttccaaacatttttcagctaataatatacttagaagggaaccaagaaattcaaattcaacccatgaagtgactaaaaggatatattttctcgtatatgcgtgcaacaatctaaaaagttgagaaaattttctacatacccctgaaaagttttgtaatctcttctacgccccttgaattttgcatcatcccctacatgcccttgagtatttattttgatctcttatatccctactttgttaattggctgttagatttttctaaaatgaccatatcgcccatttcccatacttacatggggtctacttcataatttacaatgtgaaaaattgttattcctgataaaatcaaacgggggcataattatttattgtaaaattcgaaaaagaaaatttaaattgttgaacaaattattttttgacaattttagctagaagttataaacaaaaattatatatttgttgggctcaaattttgatgaaaacagtgaacgaattacataaaagttaattcaaaatttatttaaaaattctagatttttttataaaatttattgtcatccattgttttaagaattgtgtttttatcactaaactagcacataagtataagagaggggtaatataatcaatttaaaaaatatttaacggtcaactcatgatcaactaacagaatgagcatagagaaaatcaaattaaaaactcagggtatataatttatgaggcaaaattcaggggcacgcaaaagattgaatgaattctcaagggtatatagaggattttctctaaaatgttaggaacaaatagaagtatttaacatcggaggaactgaaattgcgcactgcatagccttgtaatcttgggcttagcaatatgtattccttccttaaaaaaagattaattctgggtatgaacctcgacatgcatgcatcaagattcgcagttaggatataatatttttatagcacagaggtgtaaatttaatgtgactataagtttctaggcgtatacaaatcaaccaaataccagtagggtctttgattcgtgcaggcaaaccattagtcgtcttcttccttcctcgcgtcgcggcatccgccatcgaagctttgctcgcggctttctggccttcctcctgccaccggagacgccaccgccatcgccgcctcctactcactcctctaggaacctacgccgcagaaccctctcacctccctcctccaaccccgcggctccgtccaccgccgcctcgccgcccccgaacccaaatctaggtttttgttttggttcgggaaatctatggctgtcgtcaccggcgccaaagaggagggagagttcgccggcggtggaataataagtcgacgtccctccggtgagctaccctctctcccttccccctcatcccgaggttgaagatgcttcccctaatcctgaggttgaagatgatgccctggcaattggatcataacaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttccggctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccacacaggtacgcgatgcggcagccgaacgaccacggcttgccggcctggcatggattgcgtgaggggcttgattcattgattcattgcattgatttgttctaggtagttcaatagtagttatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactggatcataatccaacggccaggtccaggtgactgaaatgtgcctagcgaatcctaacatattcgttctttggccccggcgatgagtagcaagtttattactctctccgtttcaggttataaaacattttgactttggtcaaagacaaactgtttcaagtttaactaagttagtttcatcaaatcaataattgaatatatttttataataaatttatcttgggttgaaaatgttactacctttttctacaaacttgatcgaacttaaaacaatttgactttaaccaaagtcaccaaagtcaaaacgtcttataacctaaaacggagggagggagtacatgccaagttgttgtgaattccttgcggataataaaagtcatcatcagtaaattctatatatttttcatatatatccaaacattatttcttttatcagttctacacatacttattgtggtatcagtgctttgatgagacggataccatcctatggtcgtgtatcagaataattaggaaagcctagtgctaaaagctcgaatacctatcctaaaatttctgggaccctgcttgaaaaccaagattttgtctcaattcagactgaaaatattttacacagtgaagaaaaattgtgcagaaaccaaacgtaaactagatggatcatgcattgtttcagcaccttctaattagctagttgtcttgaacagtacactccttgattcttctgtatttccacttattgttccaattccatggataacagaggaaagtaaccttgttgcattcggcatagaaatgggtaacaatttaatacaccaaagaaaactacaagatcgtggccatggtaaacaaatcgatgagaatgcaagaccaggtgtaaggcttgaagaccttccatgggtatgttcatcttaacttcttttctgtttgagtgttgggtagaaatgggatttatttataatctccaaatgtatgtgatgcatttgctgcaggaccttgtagtatacaaaattttatctaaattaccactgaaagaggctgcaaaaactagtgttttgtctaccaagtggaggtgcatctggttgacgtgccccagattgtgttttgatggtcttgcgatgttcaaatgcgaaaggggtgaactgttcttacacgctcggcaattcattgctcaggttaatgctgttttgcaaaaataccagggagaagtggttgaggaatttcatatcagatttgattttcacagcataccagctcattatcttgataattgggttatcttttccttgtcatctaagatgaagaatctagctttagatctgcaaaccaatgatattgaacgatatcctgcacgctacaaattcccctttgaacttttggacagtggaagcttgtccggtctacaacatgtgcagttcagttttgtatctatcaaaccaccttccaagttcagaggtttccctaacctgagaaagcttgatctgcaacttctagatgcctcttcaaaggattttgaaactatgctgtcaaattgcaaacttcttgaatggctaagcatggacagatgccgcctgaatggtgaacttagggtaggtagtccattgccccgtctggtatacctacaagttgtgtactgccaagtaaccaagatacaattccatgctgtggagctagctaattttgtatataaaggagactttgtgcccatagccctcaagcattcgttgaagctggaaaatgcaaacatcaggttatatagtttgaatgatcggcatgctatcagtgacctggtaaaatgttttccgaacttgcaaaatctgaattttcacctttcttggaacgatgcagaggtttgttctcagaaactaaccctccatgctacagttttagcttgtttaacataatctagtgaatgatctttgtccttttgttttccagactaagttgttatcagatacaccttggaagttttctcatctcaggtacttgcggttgaaaaactttgcagattctgggatcgtggagacgaatttttttgtctcttttctcagggctgctccttttattgagaagttagagatccatgtaagtgctcttatcagtaactactactattctccaaactatttcttcacttgtatgttgacatgtcatgtaatactgatctccttttagtatcctgggtataccatgcagtaaaattaggtcagtctgctcacactggtcgttcatgtcttggttttagcatgttataattgactgcatatctgtgtattgtttctgagaatctgtctctgcacaatatatttttgtacttctattcagaaaacaatttcgccgttgtttacccaggagcgtttgcttaggccgtgtttagttcgtgtgccaaatcttttttgaagtatacggacacacatttgaagtattaaacgtagactaataacaaaacaaattatagattccgcctgtaaactgcgagacgaatttattaagcctaattaatctgttattagcaaatgtttactgtagcatcacattgtcaaatcatggtgtaattaggctcaaaagattcgtctcgcaatttacatgcaaactgtgcaattggttttttaatgctccatacatgtgtccaaacatttgatgtgacagaatttttggaagtttgaagggaactaaacactgccttagcaaggttttctttcaatagagtcaagtgagagtatacaattattactttgcagagtgggtatattatcgtatttttgcaaaatttcccaaacagcttcactgcttatgttacatctggatacacacaaacatacagttacattttcttttttttaaaaaataatgatgatgataacaatcactagatgcagtatgtatcatatcctaggtacacatatattaaaggatgtggatctaaacccagctgatcacatattgttatgttttaaccatgcagttttccatgaatttattaatactggatgaatcgcatgaggaccatcctatcaggcaacaacttggacgctgtgaatacaataacctgaagaacatgcgtatcataggatataaaggttcaagagatcaggtcgaatttcttctacatgttgtggagaatgcccctgcacttgaggttttaactctagaggcagctggaatagagtaccaggaggtttcatttgtgttgaatgaagcgtggatcgacagaattactcagagtgccgatagatctgctctgattgctcaacagtatctgagggagaaacttagctcaaagacacagctttgtattaagactactagttccagatagagctagcgctctatgcaagccatgtgaaaatagccattagtgtaagattaattaaataatattattataaacttgaaaataattgagtttatttgatttttctaaaggaatttgaaagttttttttaaataaaaaacacattgtttagcagtttggaaaacatattcacggtaatgaaggaattgcaaaagtaaaaggaggaaaaaacacacccttaacatttgttactctatccatcttaaattgatcatcatacacccttagcatgtacacattctctcttgctacattaattgtattcggatgaaatctgtgtccatgcagttatatgatgatcaatttgagaaattttggattttattatatgataatcaatttgaacagatggagtattggttagttttaaaacaaacaggtcctattgtttagtagtatatctcttctctacaacttaaaaagtataagaaatttccgtcgtccgtaaaaaaaatatagagaaaagaaaaactaaaaaaagaagtccgattccccttaaaaaggaaaaaaaagttcgagaaaaaatagcgaaaaaaaggtagatccgattcccctaaaaaggggaaaaaaaagtccggttcaaaaaacagaaaaagtggcgaaaaaaaatagatctgatcccttaaaaaggggaaaattttcctattcccacgcacggtttttctttttttcttcctttttttcgtttcttttcagttttttctttcccttttttctttttctgtttttttatttcttaatactatgtatgtatacaaactttatatatacacatatacaacctttgtatacgtgtattttttatatgtttgtatataaactttgtatacatctctatctctactctctagtctctatctctactacttaaaaaattcaaaatgtttccttcgtccgtccctacttaaaaaattcagatagtgggaaaaaagggtttgtaaacgagaaaaaaaagtaaaaagggtgggaagcgcagcaaaaaaaaagtccaatttcttcgttttaatagtccgtatatatctcttctctatgcctaatctaatctaatctatttaaaaagagatgttttcatcgtataactaaaaagagaagttttcatcgtacaacttaaaaagaaaaaaatgcgcgagaaaataaaaacggtaaaaatgaaaaaatgcgcaagaaaataaaaatggttaaagaaacacgtgaggaaaaaatgtcagagaaaagcgctaaaaaaaggtttccgtagtcctaaaaaataaaaaaatgtacgagaaaaaaaaatatttccatcatccgtaaaaataataaaaaaacatgcgaggaaaaaacttttagaaaaaacgcacatttctaaaaaatggtttaaaaaaacctcgcatgaaaaatggtttgaaaaacgctaaattgatggacgccttgggtcagataggatccatcgatttttccatctcctacacaacttttgtttggtcatctattctcctgtattagagaccctgcacgtctctatatgcaattatcagactatttttgttaagtatagctactattgttgataacatatgatatggatataatattaaaaaataaacatatttttaattgttatttagagaagagttcacagtgactctattttgtgtagatttgaccatgcgaggtaatgtaggatttgattgatcgtattattggttgcaagaataagattcaaagagtattttagattatatgcatgttgtcacatgaataatctaattattttaggtaaagcaagcatcagtgaggttgtcatcgttgaggttgggccatttcatttaagatgttacaatttttttgattgtcttagctacaaacgatccatacaaacattgtcattgacatcgttatgtatgaaaatcctattttattattagaagtttttcacccgttgcaacgcacgggcatttttgctagtattataaaaatgagacatgcatgaaaaaaggagaatgcaccgcgtggccgtaactaggggtgaaaacggtacagaaattttcgagatttccggctaccgtttccagcttgcaccgaccgtttcagtcggtatcggtaaccgattgtggtggaaatggaaacgggtgatatcttctggaaatggtagtggaaatgggatggaggtttttccgaccgttttgtcggtaaccatatttgtacggtaatttctgtcaaaatttcgaaagttccccagcggctcagctagctcaacccattggaagcccatgaacagaaaaaaattctggtaggcttgcagcccataaaaaaaggggaagtgaccagggaaaatgctgttaaacctatgacatggcgtgtggattttgctgaactttggtctcctcaacttatcgatgtataagtattgttgaactttgtttatattgtttgtcaaacttattatcatatcattaatcatcatataacggtgttatgtggagtgtgatgatgcaagaataaagttaaaaagtcatctacgtgcatagttaaatgtgtgttatgccacactctggtgattccgacatgaattttcgacttccgaccaatatcggtatattccgttccgatggtcccgtttccgatataccgatatcggcgatattgccgatatcgttaccgtttcaagtaccgttccgattccctttttgagaaaaaaaatatgaaaatgaaaatggtatatggttttttctggcactattttcatccctagacgtaacaaacttgtgtctcacgatgtgtgtggtgtgggccccacccccagccgtaacagccggataaggggaatttaactatttagcacttttaggtttgacaattatctaaatgccctttttagttagatttgcagttaattttttgcccctctaaagaggtggtctcttagggcctgttcactttaatgccaaaaaaaaatcttaccaaatgctaaaatttggtaaagttgccaaaattttggcaacttgccaaaattttggtaggatttcttatatagttaccaaaatttaacagcaaactaaatatagccacttttttggtaactttatcaaaatttggtaagattgaaaatggcatcaaagtgaacagtcccttaactatttgccacttttgcccacgccgtggcgcgccagcgtggcaaactctggtgaaaaactccgtgggacccacccgtcagtctctccctccccttcgtctcttcccctgtgttcgttgccccatcgccgccgctgccgcccatcttctccactgctcgaccggcgccgcctcgcggccgaccaccgcggcaccgccccgcagccgatgccaggccttcatcgccgccgccgcctcgcagccaaccatcgccggcgtcgaggacggaggcagcggcccgggcgaggccgttcaccgagccccccaaagctctgtgaaccacagctcgccgccgtccatgctgcaggtatgtatcatcacggtggtcaacgcggcgaacgtgccaccgttgtcctggggtggcgaccggagctagatgctctcgatgagacggaacggatcgccgtcgccgcatcgaagacgggaaagtcgacttgcaatccatccatgcgggaagctccgtagatggatagagaacgcatcggcgacggtgaagcgcagccacgcgcgcagcgtatcgggtggccaccgccccgaccgctgcctccgtccacgacgctggcgatggtcggctgcgaggcggcgccggtgatgagggcctagcgtcagctgcggggcggtgccgcggtggtcggccgcgaggcggcgccggcgtcgatgggggggcgccggtcgagcggcggagaagatgggcggcgcggcggcgatagggcagcgaacacgggcgaaggggagggagagactgacgggtgggtcccacggagtttttcaccagagtttgctacgctggcgcgccacgtgggtaaaaagtggcaaatagttagaccacctctttatctttataaaggaaaaacaaaaaataatttaagatgggtatttgaataattgctaaatctaaaagtgacaaatggttaaattccccggacaaaaaccctcccttctcccccaaatcacacctgattcgggggcgccgcgccgcgaatcgctcctcctcctcctctccggctctctctctctttcctccatccgaaacctccaaaggcaggcgagggcgagggcgagggcgagggctatcaatggagtcgcgaggcgagggcgatggcgaaggagcctcaatccggcgagggcgagggcgagtaatggggtcggagggcgagggcgagggcgaaggcgaaggcgaggaggtgaagtgggcgatgctcttcaccctcccgatcccggtcaccgacgaggagcttcctccgaccagagacctggccatgagcaagcagccgccgccgctcatctcctttctctgccttccgcagcggagcctcggcgaggccgcccactgcttcgttgagatagtctgcgcggattctgctggtcggcttctcttgagcgccaagccgcggccagcaccggccgcaaccacctctgctgctctgcctcctcgtcaaggcgtcatcatcatctgcgacgccacaaacctcaaggtcatgcgcctcccgctgccagtcggcgcgacttgtgatgacaacgagcgcgggttcccatgcctggcggtactcagcgatccgcgcgacgaggaggatggcgatgcctacatcgttgttctactccatgcggacgcgagcggagccttccaggaggttctctgctatgaatccaagaccggaggagtactcgacacacagacccatgaccaggactggagcgacacggagacccacgaccaagactggagtgagaagttgctgtcctgcaattcgcagcagccaccgaggggttggcacagacacagccacagccaccgtgcgatacctctcgatggcgaggtctgttggattgatgctgcttatggtttggtgctatgtgaagttctgttggaggatcccaggcttcggtacgtccagctcccagaaggctgcacgatggatgaagacgatgacatggggtcgcctgctgttgtagagaagcttaggagacgttgtattggtgttagtgatggcaaacttagataccttcagatagacagttcaggacagtcgattgccgtgtggaccttgatgactcttaaggatgtcacattttgggagcatacattctcagtcgatttagtatctcttcgtgctgataagagtttccaggaagcaggactgaacccacacatattcccctcagtggcaggcattcatcctatcgacactagtaccattttcttagtgcagaactcaatcatattttctgtcagctcagatacaacaacttcttctatcaaagttggtgatcaccacaagttcctgctcaacgagaatgagatcactccgagtctgtttctccttccgtggctggttcatgacccagcagacctgcttccccaagagacaccaccgagatcaagtaagcacttctagtttcccttgtgattactacagtgtcatttgatacccccatcatatattgttagtttgctctctatattctgaaatgccaaattgtttttgctcctgccagcatgtttttatcttgtctgaaatgttagaatggctaatgtgggttaagtcatgttgcttgctgtttaggttattcaaagaagtgcctccccgaatatacactgtgaattgataccatgatactatattgttagtttgttctctatattctgaaatgccaaattatccctgccaacatgcttttgtcttctctcaaatgttagaattgttaatgggggttaagccatgttgcttgttgtttaggttatttaaagaagtggctcctcggatataaactgtgatttgataccatgagccatggtatattgttggtttgttctctatattctgaaatgctaaattgttcttgtacctgccatcatgcttttgtcttctctgaactgttacaattgttaatggggattaagccatgtttcttgctgtttagattgttcaaagagatggcttcgtgcccttaaactaaagcaagcactcaagagggggatcgtgtggctgagtgataaccatgaagttgtaactcacgttggagatgtaatagattttcttaccattcctgctggcggttcctttagatctgcagctatttgtgtcaagaaggttggttcctattgttcgaaaacagggaagatattgaaatttcacaattcgaggttacatgcaaatgatccggtcaaggcattgccaatggaagatttccaaatcatcaatgacgtggatgaagatgtcgagtcattgtcaatggaaggtatccacatcgtcaaaaacgtcaatgaagctagaaggtttatcaatcagtggattagctgccagcaaccacatagttgtataatggatgtggctaagtctgtgggtgtggaagagtgcattaatatcttgacgtaccttgggggtgaaaatgccacgttcatgctgatgaattccccgacattccttgagaaaaccggcaacaacttacgcaagtcttctgatttgaaggagtgggtctacctaaaagagtagcagccatttactggagacttatctgactgtataagaggaagacagatacaggagcagaacctctcatggtaaggtttccattttaccccatgtatggctggtcatctttttttttccctgacacagtttctatgcattaatagtcattcacttgtgataatcctttagtcttcagtttgtattttgtcctgcatcttttgtgacaaacttctgcatcgatttctttctaacagagcttggtactgttcttaataaagttatatccatttgtcctctaggaaactgtatagcatgtctggtttggagagacttacctgaaaactgttggaaataatggtttgttggttgccatacatactcatgccccgtccttgtggattttcaatctgtgtacatgtgctaaaatatggcctgaaggtagtttagtaattgggaataatggtttgccctggtatcgaaaatactgggtttatatcccaatccttggttgagaatgtttatgtcctggtagtagtgttgaaggatttaagcccaggtaatctcagtaatatcttttcagtctaagaaacaggttatttgttttaagataatcttgcatgctggttttcatctacaaatgtataatacacaacgctgctgacgttaaatcaagacccagcttatgatgtttttatatgagttatccattttatatttctatatatttattttcttctataacaagatgttttgttagatgatttctgatattgaacggcttacaggttgcgatatatgtacctaacttccttattgttttgtttggtcctctgcaaattcagctgcaatgtagatgcggtctagaggaagacagaactacaggagcctccacttgttcattcgtctcttcagaaatttttgttgcttctgatcgaatgacgcagaattggttgccttctttttgtaaagatagtagataggcacatgctcagaagccaaaaagaaagccgtcaacttttttgttttcctgttactatgtgttggccattatgccgtgaagtttacaaactgctgaaatttccaactacgtagaatgtgcgcctgaacaattttgtgttctgaaattaatttgctgtagtttccacggttattgtgtgtatgataaatgatgcgactgatcatccacacagtttagaaatgaaatatacatatgctcaattctccagttgcaaatacatatcacaatatcaggcattgcctgtatactttttattcactctaattattcctacataggactactaacctagtttaattccttcagaaatcgattatatgcgtggctgaaattgagtagtattgtgctgctccagccgaatactgatggcttcgtcgccgccgccgccgcccctgctgctgccattattcatggtcgtatacttttttcactctatttgtccaatcgtaaatcaattcatcaggcactgcctgtatacttttttccctctatttgtcccaacataagtacataggactaagctagtaaattttacatcaaaactgaacccaaaaaaaaatcaatcccttcagtagttggttacaagcgtggctgaggttgagcagcgttctgctgctgccggaggccgatgccttcatcaccgccgccgccgccattatcatggtcgaggctcgagggccgccgccgccgctagtagcgcctcagtgtccctgcgtatctgatcgagcgagcggcggaccaaggggcatccaacctccctcatgtggcggatcatctcgtggatctcgtcgacggggacgggagagcagccggcgtcgacgaacaccagcagcgcctcgatgatgctttgcatatcggcgaccagctgcttggtctcctccacgcggatgcggctggtctccgggtctggcaactccgacagctgcactgacgaccgcgccgccgacgcctccctctcatccatggcgaccttgtagctgctcgtcagctcgtgcgtgtgcgtgtgtccatgagaccgtgactacgacgatggcgatggctgatacggtggttggttcgaggggtcgatcgatgagattgagacgtagcgtggtgtggtgatatattcggacgaatcggacccggactccggagtccgaaaggaattctaaaagaaaaggaaagggaaaaaaaaaaaaaagagagagagagagacctgtaccatgtactgggccgagtcgagcttgaaggtcggatttggtttcttgatgtttaatgggccagtttcagaagggaaaaggaaaacgaaatgagatggtctactttgtgtccctcaacgatagaacaagttttgattcgtatgatggtatctctcaataacaaaactgcttaaagaatactccctccatttttaatagatgacgccgttgactttttctcacacgtttgaccattcgtcttattcaaaaattttatacaaatatataagatataaatcacacttaaagtactatgagtgataaaacaactcataacaaaataaagtataattacgtaaattttttgaataagacgaatggtcaaacatgtgagaaaaagtcaacggcgtcatctattaaaaaacggaggtaggatttagcagctgatgaagtaccgagacacgcagatgctaatgaccactagaggaagacagaactagcatattttacccacttcatccatctcttcagaaactttcgctgcgtcagatcgaatgatacgagacggaaaaaagaagaagaatggcacgagaattggatattcttttacatagatggtagatataaggtcagaaacaaatccatcaggcaactcctccttaacatgttcgtgtactgtctcacagaaaggacgggttcagatcctcttatccatcatatatagttgactgtagaatgtgtaggttggatttctttcgtgtgatcgctctgtaactgtgattgcgtcaaacatactatctgttttcttcttccccaaagtacaaactgtcgtcctaccgttaggacagcttttacccattttgaaatacaaacagtaccgtaaaagttatcgattgttagaaaactacaagaagatgcacacggcaatatggacttccatgatagttaagtaggtatagtttttttttttaaatcgaagccaggcaaagttggagttatattaaggaaaatagaaagtatttacaatatcaccaggaaaggtgaaagagacagaacaggggaaataaagaagaaaagcaacaaggaaaacctaaaagggagacctaagtggatattctcgtgatgttttttttgccccacacatactccaaagtttgatttcgtcttgtattttggcgagtagttgcggcatggttttctcttgattttgaaaaaccctcctgttccgttcacaccatacttcccataccaccaacatgtggattgatttgagtgctttggccttgcttttgcctccttctgatccaccattccaacagtacttcgttttcatcgtattggtgttctatatcgttgcagttcagtatactcaggaccctctcccagatatggcacacaaaagcgcaatctttaaaaagatgttgggcggtttcaaggttcctatagcatagttggcagaaatagttgtttggccattgtctgatttgtagcctatctattgtccaaactctattttgcaatagaagccatgtaaagtgtttgcatttggaaggtgcccattgcttccaaatcagttttacagctgcagagcttattctaccattaaactgcgctatgtagaatgactttgcgctgtacttttcatttgccgtccaccgccaagttatggtgtcctcgacaccttctgtgagtgccacgccattattccacgcatggtagaataataatacatgaagtgtgtaatccgtggccaattatgcaggacaattaggatatgatgatgttgttcacaccaaaattagtccatatctttattttctccgcataaataattagctgcataaattagctacggactttggaacttaatttgggaaaaagcaaactctttttattcagtacattgtgatatgatgtcaaaacaaaaattcttaaaactagaggcggcagctgatctggagttgtgtcccgtgactcgtgtcttcgccgccgatgccttcctcaccggcgccgccgccattgtcatcgtcctccggaggcaaggatgcaaatagcgccgcgaggctggcgtcgatctggtccagcgagtcagcggccaaggtttctccggcgtcccggatgtcgcggatcatctccaagaagtcgtcggagtggagcgggatgaagccggcgtcgacgaactcctcgagcgtatcgtagatggctctcaacgaggcgatcagctgcctggtcgtcgcgaggtggagcaggttgcagcgcagcagcagcgagccgctcggcgaatcggacagcttcgcctgcagctacttggcgaacgactccctcgcatccatgtatttgttggcgaacgacgacgtactgctactatggttcgagtgttcgacgagacgtacgcagttgcggtctggtttgctttatgtaggcacgcggcgaggcgacacgacttgagtccgaaacgaacgagctggagctggtgaattctttggaataagttcactttgagtccctctatttgtcacccagtccgattttcgtcccttgaccgcaaaaccgggtatgacccgtcccccaacttacaaaaaccgtgcagacgaggtccctcagcggttttgaaggtggttttggctgatgtggcccctacgtggcttgtttgactagatattcgtcccacgtggcattgacatggcgcttacgtggcaattatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctccgccgtcaccgcctgcatcttcgtcttcctcctcgccgccgccgccgccgcggcaaccgcggcaagcaggccggcgacgacgacgtggagatggccgaggggaggaacaacaaggtcgccgacggcggcagcgccgatgactcgacgaccagcggcaaggcggacaccaaggtgtagctctggcgtctcaatcgatccatgagcgatcgagtagctcagtagcatgcaatcggctaagatttgctgcatgtgttctagtactagaagtaataatactccctccatctacttttgatagtgatatttccaaatctgaaaattttatttttgatagacatatttcaatccaacaacctatcatcttaataactttctcggatttaatgcacgactctccattcttccacacatgattggctacatgagcattgaaaaatgtaaatattaatgaatcgtttatttacgaggaatgactagtagcatgtttaaatagatgataagtagaattacttatccttggtctatgtgcaaagatgaaatatgactatcaaaagtagatagaggaagtattagctatcctaaaaggctaaaacacataacgtgtatgaaaggaaagtactatcctaactgaataaaacagcttttacaggcacaagtttaacataatatgtctgctttgatctttatttggaagttgtaattaaccatgtttgtaataacgcgataattaaacgagagtatccatgtgtcaagaggtcaagcgtgacctctcccacaccgtccatggcttccccgccgatgagcaccacgtccgggaggtgattgcgctcacgctccactcccacgcctgcgtcgcgtcgctgtcgcgctgcctgggcgtcacgctcaagatgctggtgctcgtccaccgcctcctcgccgacggcggcccggcgttcgagcaggaggtgttctacgccatgcgccggggcacccgctccgtccacccccaccccccagcgccgccacgccgtcgcccgctccagccggcctcctcgtcgctcggccgccgtgcgccgttccagccggcctcctcgtcgctccgccgcccatgagcgggagagagacaagagggagagagaggggacagagagaagaggttgtgaggatgacgtgtgggtccacatgggcccaccttttttttattaatttgtgtgtgcaactgacatgtgggcctcacaagttttattatttttttcggatctaattgccacatcagcgccatgtcaataacacgttggacaaaaatctagtcaaaagaagccacgtcggcgccacctcagccaaaaccggagtcaaatactgccgagggaccttatttaaacggtttcgtaagttgggggatccgtcgtatcctgttttgtgactaagggacgaaaatcggactgggcaacaaataaagggacccaaagtgaacttattccgaattctttctaccacggattctgttgggccgtttctagaagaaaaaggaaaagggacggcctgtaggctgcattgggccgagcccagccaggctgagccagcacgtggaacgggccgaattcacggaccagtgcagtgcggttggtggggaataagttcaccttacgtccctcactttacacgagtctgtctaagttccctaatccccaatattagaaatcttcacccataaactatacaaaaccgtgtaaaagtatggatatgtggtttcactgatgtggcaacctagtcagcaagataaaaaaataaaaacgttatggggcccacatgtaagtgagaaggaaaaaaaatatggctattcaaatagattcgatgtaaagttaagggacgtcaggtgaacttgatggacacgaagttgctattcagttgaagatttattcaacatttattgtgatataaaattattctctctcattttttttccaagccgaacaagaccttagtttgatgttggtacggaaaagcctactccataatccacagtttggtgacaccttaatctgagagagtagttatctaggttatgcgtgcttcaggtccttacgctctcagggcaaataataatgaaattcacattacccacataactgtcttttagtgtgagcgtcttcatggcttaataagcccttgtgcaggcgaactatattttcgctttccacaatttataaaatttttaataaacaactaaacaaaatcattttagtattgattaaactacatgcggctcataactaatcatttaactatttgtcacttttaagatgtaatgataataaatttaccactcattttctatggcatatggtgcctatgacatgtgagtccagtgataaatatgttatcatcacttgtaatagtggcaaatataattattcctttatttttagccttccacaatttatagaatttttaataaacaactaaacaaaattattttagtattgattaaactacatgcggctagtaatctagagttgtgtcccgcccggcgccgcctatatgacttcctcatctggagttgcctctcgtcgccgcagctcgtcgccgtcgctgccgccactgtaatgatcatgagctggccttgaggtgtcacaccctgaagttttccccattttgcttgctttaaaaattggttaaataaattgcccgaagaaattatcttaattaacctagagctgaattccttaattaataaatacaattaataatcggaaatagcgtggtggaatttttcttgagttccccatgctccaatgcattaacaagatttttagtggaattttcagagccttggaaataattttaaccaattaaaaatcaccaaagtgcaatttttaatcccaggaaaaatcctttcttccttttctttttcttttccttcttttttctctattgggccgtcggcccactccctcccgcgctcggcctcctttctttgggccggcccgttccccttcccctctctccgggacgctgacaggtggggcccacctgtcaggtcgtccccttcctccagccgcccgccccacgacggcaaccgccgccgaaaccgcccgcgccgccgccttctccacgtcgcgcctccactccgcgcccgcacctcgcgcccacgtccccgccctctcccccgcatctcccggcccgcacgcgcgcccgcaaatgggcgggaatcgatttgaatcccccccactttctctctcttttcccccacgtcgccggccaaatcggggggtttcccggccatgtccgcccctttcgagcccctataaagcttccccgcatctccctcttccttttccccttttcgccgcgctctcccgtgcctcctaccggtcgcgcgccgctcgccactagcgccgccgccgccgcccgtctccggccgcgtgccgtcgccactagggccgccgccgcgccaagccgccaccgcctcgcgtcgccggaaccccaccggaaccctatctccctcgcgagccggtgagctatccattcccctccgtctccggccagccattttggtcgtcgcggtcgctttctccatccctaactcctctcctcccctcctctaggtgtctccaccgctcgtccgcccctcctctcgtcgggtcgtcgtcgccgccttcgtcttccgctccggccgccgtgtcgccggtgagtcctccctccccccctcctttcctcaccttcccgcgagcgccggccacgtcgctgctccggccatgcgccgccgcctttcggccgtcgccgccgcttcccgcaccgccggtcaccgccgtcggtggccgtgcctcgccgccgcctcgccttggtcagccggtcggccttgaggccgagccgagcccggccggcgcctccctcgcctcccctttgagccaccgcctggtggggcccacctgccaggcgccacctccctccctttggagccgctgactcatgggccccacctgtcggcgccgccccccccttcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccctatgccattgataacttgggtatcaaaatgactagatgttggcttagaaaatgcttagccatgcttagttcaactaatacacaaatggggatcactttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggtgagggtgggcgtgatggagttgggtcggcaggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtttggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtacttagtcttgctctcttttcccccacaccagagttgaagttcttctcagttggagatgtcttgaagaggtgggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatttgtatgtcaacaattgtcgtttgtgtaccctggctggtcctggacaggggtttaatacacattcagcttagaaattatggttcgtgaatttctgggcgtgacatgaggcatgggtggcactagtacagaagagcttttttcatacgggcgaaatggatctttccatgcggctagcctgcccgcatggaacaaaaggtctgtaaaaatcgctatttctccatgcgggcaacacaaccgcatgcaaaaaggggattttcgcatgcggtccacatagccaaccgcatgcaaagatattttttagccaaaaaaaaaaaatccaaaaaccccccgaaacactaacccgccgcccgccgccggacgccgcgtgaccggcgccagatccacgctgctgcggccgccggccgtcgcggcgcagagccgtgcccgccgccctcgccgcctgccactgctcgccgtcgccgtcgccaagcgtcgtgctcctccgtagggcggcggatccggccctcccgaggacgatgccgccgccgctcgccgccgagagcccctagggcggcggatccgccgccgtaggccgttgtcgtgcccgccgcttgccgccgagacccccaagggcgacggatccggccttcccgaggacggcgccgccggatcctccgccgtaagccgtcgccgtgcccgccgctccccgccgagaccccctagggtggcggatccggccttcccgaagacggcgccgcctgatccgccgccgctcccgccgtctcgccgtagggcgtcgccaccgcggctccttgctgccgtcgcccgctccctcctcgcggccgccgctacgcctccttgcttccgccgctactcccgccatctcgccatcgcccgctgcctccttgatgtcgccgcccgctcctcctagctgccgccgccgccgctcccaccgtcgcccaccgcctcctgccgccgcccaagtgtgagagagagagagagaggacttcacggcggtgaggagggggagcggcagtgaggagggatggcagtggtgccgccgcccgagggagtcaccgacgacggagggatggcgggggagtgagaaagtgagagagatagagagagacgagagatgagagatctacagagagagaggagataataagtgaggggagaggaagagaagataaggtttggtgtgaaatttttgaactggtagagagggaaggaagagggaccatttttacatgcgggccacttaaccacccgtatgcaaaaattgattttttgcatgtggctttttagatttcaaatcgatttttatgtcactatattaactcatatgaaaaagttaccaaaaacaaagttgtagaactcatcaagatctacaacttttattttgaccatttttctatatgactttgtttgaatagtttcaaattgaatttcaaaatatgacaacttcaaacaaaattttcaaataataaatgatttcaaatagaaatgtcatcaacaacaaagtggtataacttatcaagatctacaacttttgtattggtcatttttctatatgactttgtttcgacagtttgaatttgaatttaaaattatgacaatttcaaacaatattttcaaatactaaatgatttcaactgaaaaagtcatcaatcacaaagtggtataactcatcaatatctataacttttattttggtcgtttcttcatacgataaagttatgtgtaacattgttcacaaaatgtacatctgttatatagttttataaactatagagagagatatgtaaattttgtgaaaatgttacgatcactttgtcggatgaaaaaatgaccaaaatagaagttatagatcttgatgagttatacaactttgttgttgatgactttttcaactgaaatcgtttattgcttcaaaatcggcgaccagcggaacagggagcggaggtctatgcgtttggcggcgagggccctcgttggtgggcttggcaacggcataccaattccatcccctttggcatcgagtcattgtatgtcagccatggtgccttgtaacaatgaccatgataacgacggtggtggcaacaacaattgtagtaacaccaccagtaccgaggaaggcttgtggcggcgacagtgaagttcatatattaacctcatgtctaggaatcgagaaaatgatcttatatattcttggaataagtttgtttagagatttatttgtaaaataagttttttaaaatggtcaaagtacttttaaaaaataaaaaaggtatatgctacagtgctacatgtcggctgcgcacggcagggcatgtccaacgccgtgacagcaggcaggcatttgccatccgcactgcatttttttgagcgaaaaccgcattgcacatagtccgtggattcagctcatgccgctcattccatgtgccagatcatcctaaccggacataatacaatatttaggtgacatgcaagaaacgataagatacctccttaaaaattcatctctacttttcccttctcttatagaaacggcccaacacaattcgggagaatttactttttgccatcctctaaaaataccagttctcaaatgccactctccccaaatttcatttccaaataccacctgcgtccacatgtcagccggtgattattttgaaactcgatgacaacatgaggggcctcatgtgaactttttcctacagaatcgaatgacaagggccggcccaattgggcggaatccgagctagtgcggcgcctccgccacctcctccacaaaccccgagccggcgagacgagcacctgccgccgctgccgccctcaaccggcactagcagagcgcagatgggcatcgccacattgccgctcgctgccttcgcgacagggacgagttcggctccgacctgaggcctctgcatgcgcatgcgctgctttggctcgcgccatggctgctcttctacttgcgcacacgaggtgttcgttgaaatgcttgggaagtcatcgcttgctaattactccaatctgatacccttgttttctatgtcccaggggagcacgtaaccaaaacatggcgttctcctagtcttctccccctgttgatcgccggcgccgtagccgtcgacgacgacgctggccgcccgccgtggacgtcggtgagcgcgcggcgtgcagcaacagcagcgcgtgcgaccgcctccggcgaggcgagcatgtggcccccacccttggccaacctgtcagcgaattgaaagtgcggccccacctgccaacgactaactagacgtgagcatgacgtcatcgatcatctgcgggcccacctgtcggcgagcgggagaaccccttgaaattgcggccgccttggcgccgcgagccccaaaaccgcaaccgcctcaacgaacgcctcctccttcctccgccgctctcccctcgccggagcgccgagagaccaagagcgcccccggcgctgcctccgccgctcgccggagcggagcccggaagcaatggagcggttccaggaccggcaccacgtgtggctgcggagccgcgagcacggcctgtacctccacgccgacctcgccgacgggagcagcgtctacctgcacccgtaccgcgcgaccgcgcgcgcggcgtgggcggtgcacgtgctccaccacttcgacggccgcatgctcatgctccacagcgccgccaacgggcggtacctggcggccacgacctcgccgtgggcggcgaccgcggcgcggttcggcctcggcggtggcaaccgcgtcaccctgcgcgacctcgaccggctgccgatgttcgccgccggctggtttcccatcgtgtcggcatccggggacgtcctgctgggtcacgctagcgaccgattcctccgagctatcgacagaggggatggcaatggcgtcaccgtcgaggtgtccgacagccgcagaccgaacacgccctgggtggtggaggccatccccccgatagaatccatacctcgccttccacatcttgtggtgagcgcgtcatgccctgttttttcgatcctttcttaactgattgcatgagttgggttctttggggatcaattgctgatgctttcttgaaccagagcttgcagattgtggcaagttgagttagttttgctcttctgggcgctattatttggttctgatgttgcgttgtttctgcctctgttgctaatcgtgcgtcctgagttgttcatgggaaagtaattcttagtagcattagtagcatttgggggtcatggtgtcaattctatttctgtatgatacattcgtagtggggagcagttcttggttccatcaggttgccatcttggttcttcagttcttgcttgtccgcatttgcttccttccagggtgcagttcttgggtcacaaattccattttcggttccgtttacttaaattttctgtccgctctatgaattttccttttccaagattatttcagtacggttcttgaaaatggcaacactacctgatcaccattgccgttctttcttaatgtgttcttggtcctcggtcacacagtgtgtgatgaattcttgcaaattgtaatgaattcctttgtgccatcttctttgctgcagggcataggacacattgcacgggcaatccggttcgtgcgagcagagcgggcatctactgatgggacctttccccatgtcgcctgggcttgtttcgagttcaccgggaggtcattgttcaatctgaggacggagctggcgcgtaggttgaactttgcagtggtctccgatgtcattatgtgtgttcgagcgggcttgtttggacggctgactcctctgatcaccgatctgcctcccaacaatgtgaccatggagatcatcgttgtcacggctgggacgattggtgagatttcgtttttatgtacctgtgtattactggttatcgccttctcttttcatgacagttctatagattacatgctcggtattccatagtcttggttagtcatactgttgctgcattttccctgacaacttttgtattgacatcatctagttaaggagaaactactgactactgttactgcttttaataaagttctatcacttgtcatcaaggaaactgtgcacatgtatagtaaggagaaacttatctgaatgttcttgtagataaggaaagaaagaagttgagtgaaaataagtagttattaagagtttgtcttgtggattttcagtctgtgtacagatgctaaatatggactgaaactagtcatgtgatcaggaacagccattttttagttgcatgcatagtacatactcatgctcaatcttgatatggataagactggttttatgcatcctcagtttgaataactcggttgctttttttttctttattttgccctggtattagtgttgaggggtttaatcccagatcatctcagtcagctcttgtcattatgagaaatggggccttcgatttaagacattcttacatgccttgtgcctactctaaccgtaaaagagttcacttgtacattagtaccatatcaagatacaatgcaaacactgtttccattaagagcaattttacggtccttaatgaggtaccatgaagtaccattttttctattgtaaatttggtacctcatggtacctaggtactatgaggtactaaaatttacactaaaattttagtacctcatggtacctcctcaaggaccgtagaattactcttccattaaatcatgcttccggtttctgctcactatgctggtttctatgagtttttcattttcttctttaacaaaagggtgacccagatgtttacatgatgtctgaattgagcggcttgcgagttacaatatctgtacctaactgccttattattttgtctggtccttttgcaaattcagatgccaatgagttgagattccccaatgttggtgcagtctagaggaagacagaagtgcaggagcagaacatctgacagtcactcccccattcatcgtttcagaatttttttgctggctcagaccgaatgacaggagaaatcaatggaataggcttcagaaaggaaaccaccatctgttctgtttcccggttgttagctatgggatgctctgatgtcttgaatgcctgaacatcgcgttctgacatttgctgtactttccattgtcatctgtatgatatgactgatgatccatacatttgcagatgtgaaatgttgtgctcaagtctgaatacacagagctcatctgtatgatatatagtactacatcttttgacattttttgctgtgattcctgtgttatcattgtgtttgatttcccttatgtctacaccaaaaagcagtcaacatcttatccagataaatagtggtggttggttataaagatttgctgcaatgtttctgactttggcaaattattttaattccattcacttatatgtattgtgcataagagtaaatataagatcaaacctaagcaaagtcagtttagtacttaaagtcttaaactgcatgcggccgatctggagtttgtgttctgttgctgccgatgcctttcctcacaggcgatggcggatgcgcgcgccgccgccgccgccatcgccgcccgtcgcggcgttggacaaaacccgatccgccgttgggcgtcggcacgtcgcagagcgccgctgttggggcctccactgcttctctgctgccgcggcgacaggatgagctctgttcttactcgcacacgaggtgttcgttgaaatgcttcggagtcggttcgcttgctaatcaggttgcttcttgatgtcacagggaaagcacacatatcgagcatggcattcacgggcgcggtggtcgtggacgacgacgccggccgcgccgtggtgagcgcgtgcgtggcgtgtggtgcaggtgcagcagctagctctcgttgcttccggcgaaacgggcatgacgtcatccagcatgtgggaccagcgggcccacctgtcagaggagccggaactgcggccccacctgtcagcgaagggggacaactcctttaaattgcggccgccttggcgctgacgctgagagccccgagccgtaacaaactcctctcctctcgccggagagcgcaagaaaccaagcggcgcgccgcctccgcctccgcctccgctgctcgccgaccggagaggcaagacatcaagagccccgccgccgccgcctctgccgctcgccggagggaggcaatggagcagttccacgacgggcaccacgtgtggctgcggagccgcgcccagggcacgtacctccgcgccgacgacgacgggagaggcgtctccatgggccagggccgcgcgtccgtgcacgcggcgtggacggtgcacacgcaccacctcaacgccggcgacgtcgacatcctcatgctccacagcgccgcgaacgggcggtacctggcgacggggctcgggtggacgcggcggcgcctcctcagcggcaaccgcgccagcatcatcctccgcgatctcgaccaggaggtgttcccccccgcctgctggttcgctatcaggtcggggtggggggacgacgtcctgctgcgtcactgcagctggcgcttcctccgagctgacgacaggaaatggaattggaatcggaatggcaccggcgtcatcgccgacatgatcgacggccgccgcctggcgaggtggcagtgggtggtggaggccatccccccgaggaactccatacctaggcctccgaatccttcggtgagcacgtcatgcccctgtttcctttcctgattcttgcataatcgattgcgttactgggttcttcagggctaggctaattcttgatcttttcctgtgattgctggaattttcgttactgggttcttgatcttttcttgtgattgctgcgaaattctgttagttccgcctctattgctaatttgctaatctcgtgttcccgggaaagtagatcttactagcattttagctctaggtgtccattctctatgttgcattcgtaaggaggggggggggggggggtggagcagttcttcgtttcatctgtcaggttgccacctatgttcggttcttgaaaatggcgacatccccactgctgttctttcttactaagttcttggtcctcagttacttcgtgtttgtaacgatcttctttgctgcagccctcattcggtttctttgcgcgtcgcatcattttccggcgattaacacataatgatttacaatgggtttggatctggttcactgggaggtctgcgctccatctatggaaccagctgtcgagacgaatgggcttcgaaccagaccccaactccactatgtgtgttagagcaggaacctacggacggctgactcctctggtgaccgatctgcctcgcaacaatgcgacaatggtgatattcgttctcccacctgagtcattaggtgagatatgtacctgtgcaagacttgctgtcgccttcttgttttatggctattggctaatgttctatagattacatgctcatggtattcatttagtcttgaatctctcgtgcgcattgcagtgctctagatcagtcgtactgttgctgcatgtttcatgaaaatttctgtgctgatttctttctaatgaaatgctatcaataaagtccaatccacttgtcctcagggaaaattcctatagataagaaaatggactcaagtaagaataagtaggtattcagagtttggcatgtggattttcaatctgtgtacagatgctaaaatatggcctgaagttaattttatggctgggaaggtagtagtgttgaggggtttaagcccagaccatcccaaatcccaatgagatcttttcagtctaagaaatagttgtttttttttaatttaaggcaatcttgcatgtgttgtgcatactctcactgtaaaaaagacaataagttaatcttgcatgcgttttgtatcatacaaatatacgatagacagcactgctgccgttaaatcattacaccagcttctgctcattatgctggtttctagatgagttatccgttttattttgctgttcattttcttatttcacaaaaaggtgacctcagatgtttttagatggtttctgaatattgaatggcttgtgagctgtaatatctgtaattaacttgtctcatcgttttgtttgtccctttgcaaattcagctggtttggggttgacgtgccccaatgttcatgccgcctagaggaagacagaagaactacaggagcagaacccctgacagtcacttgttcattcgtcccttcagaaaattacgctgcttcagatcgaatgacagagaactgaatgtcttctctctctctctctctttggtatcaactcttctgtttcccggtcattagatattactggccattgtgctctgaagttcacgaactgcattaagcaactaaggagaatgtgtacctggcaattgtgtgttctgacatttgctgtagtttctccatcgttatctgtgattctgtatgacacgagtgatgatcatccatacatttgcagaagtgaaatgttatgctcaagtctgaaatatagatcaggcaactctgcaaaagctgatcctgtatttttcatgcagaagggttgttttatgttttcccttttgtctgttgcaatgcatccatccacgtactgaaacttttatctgttaatgatatcggatttgcaccttgtttggtagaaaattgagccctcccagactcgagttatagagtcatctgggtgcaggttccaaattaattactaattaccgctgcagtgtatttcagacttgggagctgcagtatttgtgcttcccttcatgtccccagttttcagataggagtatgaatttactgttctgatcagttttcgcagtcttctttgcgatcatagaggatcacagcatgaaacattttctgtatcccagtcagaagtgaaatgttattctcaaatctgaatacatcaggcaactctttcagatatattgctctgtagttcctgtgtgtttgtatagaaagattgttttgaacttctgattttccccttttttttctacaccaaaaacgcagtcagatgaacaattggtggttggttatggatatcagcagctgcagtgtttcagactttggatctttgagcaaaaacaatttattttaattccattcacttagatacagtgcattgtacataagagtataacatcagaactaaaaaaaaaaaatcaaatcagtactgtactaagtgatacttaaccacatataacgcggctcatctggtgttgtgtcccgtcgccgccgaatcaccgatgccccttcctcaccggcggtgccactccaatcaccggcagaagcgtagtcgtcgacggcgcgtggaatgggccgaacccaccgactagtgcagtgcggcagcgctcgccgcgccggcggcggccgtcgtggcggcgttggacacacctgagcaatggcaactgccgccgccgccgcgctcatcggcctgtggccgcttgcgccgtcggcttgggttccacactggtgttctctgccgccgcggccggcgacaggacgggttcggttccgaacgcctcagcacggctgctactcgcacaccaggtgttcgttgaaatgcttcggaatcgttcgcttgctaatctggttgttttttgtcacagggaagcatgacagcacgacgcgtggcattcctagtcttcaccgacgaccgtggcaacaggcagcagcagctagctctcgttctcctctgctcgacgcctccggcgtcgcgagcatgacgccatcggcattgtgggccccatggcccacctgtcagagaagggggaggggaggtgcaggtgtgggcccacctgtcagcgaagggagagaactccttcaaattgcggccgccttggcgctgtgagccgtaactgtcgcaacgaactcctcccctccctccgctctcccctcgccggaaaaccaagaaatcaagaaagcaagagaaccctcgccgcctccgccgctcgccggaggcaatggagaagttccacgacgggcaccacgtgtggctgcggagccgcgtccacggcacgtacctccgcgccggcgaggacgggagcggcgtctccctgcacgagggccgcgcgtccgtgcacgcggcgtgggcggtgcacattctccacctcgacggcggcgacatcctcatgctccacagcgccgcgaacgggcggtacctcgcggcccccaggaccgggtggtcgtggaacagcgtcgacctgcgcgacctcaaccagctcccgtcgttcaccgtcgggtggttcgccgtcacggcgggttccggggactacgtcatgctgcgtcacagtagtagcgggctcttcctccgagctgatggcgggaacctcctgtgcaatagcgtcggcgtcgtcgtcgacatgttcgacttccgccgcagagagatcaggcagtgggtggtggaggccattcccccgagagattccatgcctatcctccccaatccttcggtgagcttgtcatgccctgtttcctttcctgatgcttgcagaattgattgcattactgggttctccggggatcaattcttgttcttgatcttttcttgtgtctgattgctgcgaattgtgttaattcctttctcctggatgcgattctttgctctgtttttgccatagttcaaggtgtccattctctatggtgcgcattcgtaggtggagcagttctctatgttcttcagttcttggttgctctgcatttgcttcgctccgtggtgcagttcctaggacggttcttgagaatggcgacatcattattgctgttctttcttactactcgtatgttcttagtccttagtcacttgtgcttgcaatgacttcttgtatacttttgttttgaaacttgacttcttatatgccatctaattctttgctgcagcccacagctttcagctggtgccgcatctggtacgtgcgagcatctcctcaagggaatttccgccgagaagactggcgttcgttattgttccatgggaggtcagtgttccatctaaggaacaggctggcgagtcagttgcgcatcagagagtcctctgacgccatattgtgtgttcgagcgggctccactggacgggtgactcctctggttactgatctgcctcgcaacactttggtgatagacattgtcgttatcacagccgggacgaatggtgagatttccttttatagtgatagattacatatttacatgttcatggtacttcttaagtcttgaatctctcgtgcacattgcactgagttaggccagtcataatgctgttgcatgtttcatgacaacttttgtattgatttctttctaatgaactgcttttaacatagttctatccacttgtcgtcaaggaaaatgtatacatggtttgttgagagaaacttatctgaaaattcttgtagataagaaaggagaaacaagtgaaacttcagagtttggattgtgaattttcagtctgtgtacatatgctaagattcagagttcagtgccttcgggcatccatctgtaaataacataaaaaataaaatgacttgttagttcagtgatctttgtaaagcttctttgttaatgaattagacaatcctgaagctagttcagtgattcagaacatgacttgttagttgcatacatattcatgctccttttgttattttgtcttgttagtagtgttgatggatttaaaacccagatcatctcagtcagctctttcatgtctaagaaaaagggtttttgactttcagacaaccttacatgcattgtgtatattcactgtaaaaaggttcaattgtacagttgtttcatacaaatatacaatagacaacactgttgctgacttacagttaaatcatgacaacagtttatgctcattgtcctggtttctagatgagttaccccttttattttgctgttcattctcttctttctcaaaacggtgaccccagattttttttcaactgatctctgaatattgaatggcttgtgagttgtagtatctgtaattaacttgtcttttttttttttttgctcctttgcaaaattcagctgccctctggttgaggtaccccaatgttcatgccgcctagaggaaggcagaactacaggagcagaacctctgacaatcacttcttcattaatctcttcagagttattcgctgattcagatcgaatgacagagaagtggatgtcttcaatttttttttggttgattcaggttcagaaagggaaactgtcaaaaaccttctgtttcccggtggttaattagctataggccattatgccctgaaagtttacgaactgctgtaagcaactaagtagaatgtgtgcctgacgaattatgcgttctcacatttgctgtagttttccatggttttctctatgattcgattgatcatctttttgtagagtgcaatgttatattcaagtctgaatacatcagccaactcgttttcataacctgtgaaaaaaaaaaggtgatgggctagacgtcctgagttcgaagcctcacccattctaattatttgatattaggtcattctctgatattcgtgtttttttttcataacctgtgagtgattctttgcttccatttgctagctgttggcctaacgctctgaagtttacaaactactgaaatttctaactactaaatagaatgtgcgcctcaacaattttgcgttctgatatttgctgtagttaatttccatggttactgtgtatgataattgatgcaactgatcatccacaaatttcagaagtgagatactgagatatatgctcgattcttcaattttacattaactcgcatcaggcattgcctgtcatctaacctggagtagtaaatttgacatcaaaactaaaaagaaaaaaaaatcaattccttcagtaattggttacatgcgcgattgaggtttcttcggcggtgggtgttcccaactccttaccttcgttttccacgtgcacgtttttaaaactgctaaactgtacgcgttttaaaaaaaaaatagaagaaagttgctttaaaaaattatattaatccattttcaagttttttaagctaatatttaattaatgagaacttttacggtacaatatactactagtatatactgccaatataaatgatctaacggtgtagattgaattacttaccacttacagtataaaattaaaaagggcatatttgtctttctattttattgcgctggggcaattccgttaattccagcagacaagcacactactgggtgttccttgcaagatccaatagtgattccccatgcccgtcattcaccccaggctaaggccgtcgttcacccaggcaaaggtgcaccggtgtgaggctgtcagatattgattaatttcctagtttgcattgttgatatgatgttcattggatgtttggaagatgtagattaagcgtattaattaaaggaattaatggtgattaagtactacatgcggctaccctgcttaagattgctgtatgttggtagacggtacagcccgagcaccggcctcgggttgccggacctagctccgccactccctataccattgccatcttcagattaaaatggcatagagtatttgtaagaacatgacccctcttgcagattgcatgaacgaagaagagggtaaagagtaaataacatacatctgtagactgcacatgtatgcatttttatgcacagatcagggcgtatgcttgtagagtgcgcatggtgtttaattctactccggctcggcagagggcactgcgttgccggctggcttgccgccagtatgcgggactgcatgtggccatgccaccacagggagatggcggctgttcgctttggcgggaagagggacaccgaggaattccgccgccgacgaggacgaattgcgccgccggtagggctcatctctccctctcactcgcacgacggcatcaacagatagggattgatctgaaaagcgaattactaaattgcccttacatttttttagcatattcctataatacccttgaaaatacttgcagtatatactaacagtatattgtactgtaaaagttctcttaattaattacttgttaatctatcgctccgttttctatatggaggggaacacaagtagtgttcggttgctgccgaacgctgccgacgtcttcctcatcgccggtggcactgcaattctcgccgccaccgacgtcgtcgtcggcgtcgaggtccctgcgtatctgatccaacgagcggcggaccgcggcgcatccctcctcccggatgtcgcggataatctcgtggatctcctcgacggggtacggcgagtagccggagtcgacgatcttgagcagcgagtcgacgatggtgttcatgtagccgatcagctgcttggtctcctctaggctcatgcatctgggctccggatcatctgccaactcggacacctgcaccgccgacgactccctctcagtctcagtctcatccatggcgattcttggctcgttcggcgacaacgacgatggctgatacggtggttcgattgagtcgatgagatcgagaatttgagacggagcgttggtctggttatattggcacgcacgcaggccatgcacgattcgtacatggactccaagtcccaaaggaaaaggatttgtattggccggttctaaaaagaaaaggactcacgtgttcgacaaccgaaccacgatcatgcagtgggtggtgttcatggtccaccgtacagtacatatatgtatgagaatcagggtttaatctggcggaaaaccgacaaatcccgaaaaaatttcgcggaccaaaatttgaatacaaatccctaagcttactgatatgttcacaaaagccggtcagcttcggcaaaattccaatagaaaccatcaaaatttcaataggaaaccaaaaggtaaaacgtgctgaaaactgtccggttttatcgaaaagccgataggtatcttcgaaaaaccgataagaaaaccaagtttgttttttgttagaaaaatatagaaaaaaatgtgataattgggaaaaaaaatcgtgaaaacgttatttcctataaatttgataacctcccatcgacatacccacgatatgtaatatatattcataaaagacagttcatatcactcaccaaccatcggccaaatagaatgcccatcaccaaatacataactctgtgaccgatatattgcaagaattaatatatttccagttgtttttcttccctgaagaagcatgtcatacaagctgctccttcagaagttcactattcgccgggcttcagaagttcactatggggtgcattactgacaattcaaatttgccgcagttaattttgaaatttggatttgggttatgaaatttggatcgtagttacatcatgtattttcttggacctactgaaagttgctctactgccaaagtgccaatgctggtttgggcctctctcagcgaagccttcatttgggcgcaattttgcaaatcccccaaccaagccatttctaccgccggccgtcgcggcgttggacacaccgaacccccgagccgccgccaccgccaccgccgccgccacgcgaggtcggcacgtcgcagaatgtatctgggacgtcgacctgcggccgctgcctctgttgaggcctctactacagctgttcgccgtcgccgcgacaggacgaattctcatcttcttccgctccgttctactcgcgcatgaggtgttcgttgaaatgcttgggaatcgttcgcttgctaatctggttgttttttttttctgtcacagggaagcagacaatcgagtatgtgtatggctttccttctcctctacttaccagtagtcgtggacgacgaaactggctttttcgccgtggcgccatggaccttggtgagcgcgccatggtcgggtgcagccggcagctagctatcgttgcttccggcgcaacgagcacatgacgtcatcgagcatgtgggcccggaggcccacctgccagcgaacgcggggactgcggccccacctgtcagcgaagggggacaactcctttaaattgcggccgccttggcgcctagaatcccgagccgttaccgtcgcaacgacctcctctcctcccttcgctctcccctcgccggagctccaagaaaccaagagcgccgcgccgcgccgcctctgccgctcgccgatcggagctccaagaaaccagagccccgcgcctcctccgccgctcgcccgagtggagcggcaagaagccaagaaccgcgcgtcgcctccgccgctcgccggaggcaatggagcagttccacgacgggcaccacgtgtggctgcggagccgcgccaacggcctgtacctctgcgccgacgacgacaggagcggcgtctccctgcagcaggaccgcgcgtccgtgcacgcggcgtgggcggtgcacatactccacttcaacggcggcgacgtcctcatgctccacagcgccgcgaacgggcggtacctcgcggcctacagggccgagggatcgtggaacgtcgagcggctcaacctcaaccggctgccgtcgctcaccttcagctggtacgctctggggtcgagatacggggacgacgtcctgctgcgtcacttcaagagcatgttcttcctccgagctcttttcaggagggatcgtatcagcaatagcggcgccgtcggcctttgcgcgatggaccggggcaccacgaccatgcagtgggtggtggaggccatacccccaagagagtccatacctacccttccagatcctttggtgagcacgtcatgccctgtttcctttgctgatgcttgcagaattgattcttgatcttttcttgatccttcggtgagagtcgattgcattactgggtccttcggggaccaattcatgatctgttcttgcgtcagatttctgcaaatagtgttagctccgttcttatctgcaattcttggctccattcttgccatatttcctcctctgttgctgatttgctaatcgtacatcctgcgttcatgggaaagtaattgttagtagcattttagctcaaggtatccattctgtatgttgggagcagttcttggttccatgtgtcatttcttcagttcttgccccctctgcatttgctctgctccagttcatgaaattggcgagatcacaattcctgttttttttccttactactcatatgttcttagtccttagccagtgcttgcaatgactggtgtgttctttgcagccgcccagttctttatccggtgtgtaccgcatctggtatgtgcgagcaaatcctgatgggattatctccccaaacgactggaggctgttcttattctacggtaggtcagtgcgcaatctaagtgcattgctgtcgattgagttgggcatcagaaggccctccgacgccattttgtgtgttcgagcgggcttctttggacggctgactcctctggttactaatctgcctcacaacaatatgttgttgaacttggacattgtcgttatcacagccgggacgagtggtgagatatccttttatagtgatagatttacatatttacatgttcattccttttgtcttgaatctctcgtgcacattgcactgcgctacatcagtcgtaatgctgttgcatgtttcatgacaaattctgtactgattcctttctaatgaactgcactagatcagtcataatctggaaattcttgtacataagaaaaagaaatcagctgaaaataagtagctattcagatttggattgtggattttcagtctttgtacatatgctaaaatacctgaagctagttcagtgccttcaggcatccctgtaaaactcctcttttattaatgaattaggcatcctgaagctaggtcattgattcagaacaatgacttgttagttgcatacatattcgtgctccttttgttattttgtcttggtagtagtgttaagggatttaagcccagaccatctcagtcagctcttttcagtctaagaataatggtttttgatttaagacaaccttagatgcattgtgtgtactcttttttgtttttgctgggccggcggaagagaagtcgtctgattttttgttaaaggatgaccccagatgtttttagatgatatctgaataagtgaatattgaacggtttgtgagttgtagtatcagtattaacttatgttattgtttcgtttggtcctttgcaaattcagctgctgatcggttgagataccccaatgttgatgctgcctagaggaagacagaacaacaggagcaaaacctctgacaaagtgacaatcacttcttcattaatctcttcagagcttttcgctgcttcagatcgaatgacagagaactggatgtcttcttttttatggttgatataggttcagaaagggaaagcgtcaaaccttctgtttcactgttgttctgaaggttatgaactgctgtaagcaactaagtagaacgtgtgcctgaacaattgtgcgttctgacatttgctatagtttccatggaagtgcatgattcgattggtcatcgttttgcagagtgaaatgttatgctcaagtatgaatgcatatttctcatgaccttttccctgtattttcgtacatatgtactgctttgtgtatggcaatgtattcatgtgccaaaagaacaaggcttaattttcttggctttgcattttggtagagaattgagcctcaaatttcagagccatttgggtgcaggttttcaatttcagatttagagtaggcttactgaataccttacttttgcgtaggtatatgttctgaaaaaacggagcaactcttgtgtttcctggttgttagcttcaatgcagacatcaaatcatctgtttgttatccctggtgctgtttctccctgacaagaagctgtgtatgttttggcctttatgttatgaaactttcagactgctgagtgctgacagcattaggtactagaacatatgcctgaacaattgtgtagtggtattggttataattttcaccttcgtctctgtgactgatagcaagaacatatggctgcttgacaaataaattccgcagtcaatttttcgaagttggatttgaattgtagaatgtggatcgtagttaacatcatgtataccaaaagctcagcacagagatatcatcctgtgtatttgttgtcgttctagctacagtagtaacaatgagtattttgtccttcaacctgttgaagttgttttcagttgttcacaaataggccatatacatttgttgagaaaaaatatcatccgagggcgtttggtctagtggtatgattctcgctttgggtgcgagaggtcgcgagttcgattctcgcaacgcccctattttactttctttttcataatttcatttagtgctgactttgttgcaactttgaactttcatcatgtagaattttcctgaatcctgatgtctactcacaaattatcttacgagccagtctttgaaattcatttggatttgaattttacgcaattttatactgaatcacttcctactttcatttagtgctgacttgttgcaactttgaactactttcatcgtatagcattttcctgatgtctactcacaaattatcttattaccgtattacgagtcagtctttgaaattcatctggatttgaattttacgcaattttatactgaaccacggaatcagttcatctttttttagcattgaaaaagttcaggcctctcaagcttggactgccacttgctccacccaacgcgcgagtctgtgtgccgccgccgccgccgccgctccgatggaaaccgccgcggcggcgccgccgcgcgtgcaggccctagccgacgccggcgtctccttcctcccggcgcagtacgtccagccgccggaactccgcccggaccccaccaccaccacccaccgccgcgccccgaccgccgcctccctctccgtccccgtcgtcgacctctcatcgcccggtgcgggcgacgccgtccgccgcgcgtgcgccgagtggggcgccttccacgtggtcggccacggcgtccggccggggctgctcgacgcgatgcgtggggcggggctcgccttcttccgctcccccatggaggagaagctccggttcgcctgcgaccaggccaggggcgccgccgccgaggggtacggcagccggatgctcgccaacgacgactccgtgcttgactggcgcgactacttcgaccaccacaccctcccggattcccgccgcgatcccacccggtggcccgatttcgtccccggctacaggtgattgcttgatcagttcatgccttgaataattgcaactggtacagatttttgcatgcttgaaatcattgagaaaaatgagagtcaatgttcagatatgataacaaatagaaagtgggcaaggaaaatttggtatcctacattttgggttgcctacttgcctctgttgttgattcggggttcatgttcaccgtggaggaatattatgtcatgcagatgatatgattatgagacttaattttgtactttcatttgaagcctgatagttctgcgcgtgtttgaaggatttttcggaatgctgtttgctgttgcattggcatcattgcatcatttctgtgtgtagtcattgcattgagaaaagaatgactcaaaaacatctagtgtcattgactcattgtacagtggacatatccatggaccatcacatattcgcatgagctgcggctttaacagataagctaataacttaatgttcgcagggacactgttgtgaaatacagcgacagcatgaaagatctcgctcaaaaattgctgcgcattgtctctgaaagtctgaacttgccaccttcgtatatagaagaagcagtgggggaagtttatcagaatattactgttagctactattctccttgcccacaacctgatcttgctcttggattgcaatctcattctgatatgggtgcaataacacttctaatacaagatgatgtgggtgggcttgaagtactgaaggacgggctgtggatacctgttccttctttgcctgatggaatccttgtaattttggctgaccagacagaggtaatattccttcacatgctttaatatatgctataccttctaatgctatctaatgtgtaatcaatatgctccaaactaccaaaatacattttgctactccagatgattttattcaagtattatttttatggtacaaattatctgttaggtaatttttgactctttaagtagtattaatctggcatttgcaattcattttagtttcattgcgaacttaagataagaatatggtcctgtgatacttgttcttgctactcatcctgcttgtattgtttcgaatagcttgtttactgttgtattccgagtagctgctaccaatgcgttctttccatataatttggctcctgcaatccaaatgctactaatgtttgcctttctctagatcataaccaatggaagatacaagagtgctgtgcatcgagctattgtcaatgctgatcgtgcccgcttgtcagtagcaacattctacgatccatccaaatctcgaaaaatttgtactgctccacagctcgtttgcaaggagcatccacagaagtaccgggatgtgatatatggtgactatgtctcatcttggtatagcaaaggcccagagggcaagcgcaacattgatgccctcctgatcgagcaatagaaccagaggcagcattatatagacagaatagagacattcatgcgtgttgtgatgctgtccaagattgccgatcttgattaataaagagaataacattgtaccatatgaatggttcctggtttttgaagtttctatgattcttatcaatacttcccttgaagcaaagctcacaattgtgatttctgaccaactgaccatcatattacaacatgacatgaacataggaaagaggaaaagatactgattcttaacatctatttcttgctaatatgatcatgctgtggagtaattcccagcttcctggagcctcacctccagtagctaagtttgtggtagtgggagtattgcactggtagctggtcagctggcggtagtatgtttcttcttgggatcagtgccattatgctgcagcctctcaggactctggaatcaccagtcaccaacagcatcaagctcctaagttcatcgctgaggtagtactgcactcatgcttatttctaataatgtaaatacttcttacacttcattgatgtgttgttataagttctatagcatatacgatcacttgtagaaaaaatttccatgaaacccatatggaactctttgaggtaaagtgattttcaataccggttcttctgcaaatctctttgcatcaataatgtaaacctacaaaaatgatgttcaataattaaggatatgcatggaaaacagggtgaagtcatgtcatgtgcttcctttaccagtaaatcatctaatgaggtttaaatacctgagacacattagttaattcatcatggacatatgttattatccatccatcatcttcatctattccattttcctttgcaacaaactgaactccagagcagaaggttttctcttttaaaacgtggtactccactgatttcagttgtttgttttcctgcggttgttctgaaacttcagtccaagtaaagtcatagacaaaaaacagttgatacttgtgcagtattttctgaccttatcttgcctgtcgaagtgtacctttgctatcctattatacttgaataaacctgcagcattacacacaatcgtacatattcagtatatgaagattgcatgagtaacttaaaatgaacaagcacatactgtaacaagacatgacataagcaattaaactgtcgagaacaattatatatataagtctcttttagtctttctgcaacttcactggtaggcaattacctatttcactggttgctactgagtcaacaacctgtgcatatccgtagttgtttttgaccccaacaaagtcttcattgataacaggaaaatccattgcaactttctcatctgtaagataaccttcttttgtagttccgcttttcaagtttagcctccattcatatggacgagaaaagagagtgccatctactgatggatcaaaaccttctgaattcttatctggctggagaaatgctcttccagaacattttgacttgtcgtcatcatgacttgcactagagagtaccgaatcaagtgttcgacaacctctgataacaacctgtttacaggcttttgccaatgagtataaatagacggaaaaaagcatcgctaatctatattttctatgagattatcctcatgtatgtgacataaacccttttatgttgggaaaattagaatgtttgaaccacaagaattacacggaaaaattgttctattagattgattttctgattttgtttctgtactctaaatgcatctatggtaaattaatgattacataactaggtccatctgaagtttctataagcgtaatatcgataggatttttggatctcgtgtgataatttaatacatgaatactgattttgtaaaggttctagcgaaaatactggaaaaatagccaaataggcagtccatagctaagtaaagctaggtagttagcatgttgcacactacaattttgattcataaggcaaaactacagcagaatataaagctttttctggataacagctaatcatatctatatatttctctggacaaaaataataagaccatcaattgaaatagcagaaagattaatccagaatgtgtattatagttgcctacagatttttttaaaaaacgatttcagtatggtgaacatatatacaagtgcagctacatgcctcatgcaccagatccactcatcccacctctagtatgaaattatcagtagtgttataaaaaaaaagaagcaatgtctgttctgaacctccaatgaccattaaagctgtttcatgatccttaattttatcttttgttaaaattgaacaatcacctcatttccatcctcaaagcaattaaataaatggtaactgcaatgattctccacatcaaaccagatgatggaatcagcatcaccaaacctaggcatcactccaatgcgtgatatcccgcccatatcattttggatgaatctgaagagaaacataaccacattattatggattattaagtcagtatgcatatttcccacagaagtggttgtcatagtaaagatggtgtatatgtatgggacccacggtttgcgtaaaattgtccttattaagccgaagtggagaggatagtccattataatattgtacctacaatataataattagtagttacaagaaaacgtattgttgacagcaatataagatctcataaataaaagctagcatactgtgcagttactccgatgtcatgaatgagttttccttcctcgaatttgagatcgaccttgtgaagaagcctctcaccatcagctagttcatgtgaaagaacatcacttaataatattgtaataaaatctaaaagatcatttttgcccacaataatagcaagcaagacacgtgtgtggttgagaaatttatattggttcttttgatacaatgtttgttgatatttctaatcttatctagctgtctttttttttcatgtaactattgccagttactatagtaatattgtgttccgtttacactttatttttattacttatatgccactcgataatttgcaaaaccccagcctggacaggcgctatcaaacaaggttcaacatggtggatctgagtgcatgtgctagttaaaaatacgagttgcatataacaaatgctacaaaaggttggtgtaatatactctccctgacccaaaatgtaagggattttgggatagagggggtagcccattttcatgtattgttttacacttgtctagtgattgcatttatgttccaccaaatcacaacttacaggaaattactccaagcacatagtggggtttttcaatattagttcccatcgtcacgagttctccacttccacaaatcttctgtaaataaaatcatatgcatgtaagcccttgctatagatgaatgatgctgctcacaacagaacattatgaacaatttgagtaactttagttggcattaaaaatattccaagaacattatgtgtttgaactttgagttgatgatccatgcttcagtaatcattcaccatgtgaatttgtgaagttaagaaatggtggctgatggattaattgatgaaagatctctactgaaaattattgaataataatattaatatatcactggccttgcctactgttcatactaaaacatcaaacacacatttaaagaaataatgagcaagctgtaattgcataatagaatacctttgggtggctagtgaaaggttggtcccaagctccattaatgttgtaaggtcctagggtgcggagattattgatgtcaatttcgtaaggtagatgattttctgtggcagcaaaagctcgtccagcatgctgaaatatggaagtatttgcactgtccttcacaggctttccaaatctcacctataaatatcaccgaagatgatatgtagtgttaaccatcctcaagaccaagtttaaacaaaaaaatcatgtgcatctgacaattatatagctactcaaattccatgagaaaatgattcaacagcggcattcagctttttccactggagaaacaactaatttgttgagtttcagatattatgtaaatctattccactggagaacagtggaatttttacatctttctcatgtcgattcttcttgtattgaaataagaatatttttttactatgcagaaaaagactgtttcttatttatttgggtatgtatattggactgccttttcttatgcaatgcttatgtcacatccagtagttaatctgttctagatattgatttaacctgcacatcatattttcgccgtgcatctgcacatcatattagagctcaattatcctatccacctagtgtttacacttgatctaatactaaactatttaaaattaggaagacttacggtattaagaagaaaagcaaccagtgttgcacatggctcgccttcagcagatggaaggaaagctattttgttcttctttctctctaattcaaaagtgtctgtgtccacatatttgttcttgtacgaaatcctccattctcctaaattgctcttgctaaggtagatagcatgcaacattccatgtccttcataatacatgtatgatgttgggccaaagatggactctgcagctgtctgtgatgcattaagagggtttggacctgttcaaatagatcaatgttacacgtgcatagaagtttagcataaatctgattcattattaactttttttggttggaaagatgtatataagcttgtgagcctggaagtatcagaactcaccatttcttatatagacaccctcaggaaaatcttttggaacctctccattgagatcgtcaatgaaaacctcatcaccaatttcgtttacaggtccaaaattcccctgtagaagactcagatgaaaattatgccaaattgatgagtcagataaattggatactacaaaggagatggaaaaaaaaagttgctcgtcgacttcacaaatttgatgctgaacaatgtcatgtttgcaaattatatagtagcacatgcatacattaacaatctttatatttacctcattcagataaggctgctcagaaaacttgtacacggagtcgatgaatcggtccagcagatctgaagagactgatttcagagcttttgtcaattcctgcatcagtggctgcttattccacccagtaactgaagattgcacctgaaggatggtacattttgaggtaacctatcccttcttatattgcacaaaatattgacttaagaaaaacaaacgcagagatctgaaggtcctattgaggtagatgtagctttatctcaactgaagaacacaaatttgttacaacacattgaaaagtttctttgttttttttcttgggagaacttacaacacgtttcaaagttagtacttgaactgcttgctggatacatgtaggcaggcatgttccatccattggtttgtctggagacatcaagttaataaatcattattatttccagattagttaccttgacggcattaggtggagacaatgaggaagcttgatcagctgggctcttccctagatgaatgcatctagtgacctgggagctgcaccctccagctctgaacatggcttgctcaggttattcgatcctctcttgtcagttgtaaactgttactggatgttatgcctgctagttcgagcttgttgcattataaagtggaggagcagtaagccagtaaggcatgcaagaacacagacaaatatggtttatcccttgctatgcatcggccatggggaggaataaaatggtctgattggttcagactagcttaagagcaaacactacagtagataaggagcatattcttgatggtctgtgggtgcaataagacagggttaattaatcaagaacaagttgattaatatatggtcgcagaaatcagtctggaatcagctcaacaagggatgcaagtgcaactaggactgatttagtcatgtagtgatgtagatcgtgatttgtgacctgcgacctttgtgattgatttgctgctgggttggcagctctgtccgtgctatgagctcgtgaatggaaggaacaccagtggcgaatcacaatgacgctcatcaggtcaatgtctttttttgatgtaaaatcaggacatgttaatcacgatgatgctcatcaggtccatttcttttttaaaaagtaaaatctggacaagttaatcaccacaccgctcattaggtcaatttctttttttaaagtaaaatcaggacaagttgtaccacatggaatttcattacggaagtagttcaaattaggctggcttttttgttgtctaatcactcttgttgatatgtactccttccgtatttaaacatgtcattgttgattttattagtttgtggaaatataaaaatcgtatgggtccatttttccttataattttgttagatactatcgttatatttaaatacgaaggtagtggcataattgcagtgtaaaccccccaaaaaactgaagagatgcaggttttttgtacttagcattcgcaaatacagtaagagtttggttttgttcgtacatacatgcacgtatatacaagttcacaagaacagcagtcaaatgtggaccatgcgcaatggacgatgggttccaacttccaaatcttagtcgggccgttgcttcaccatgtgggctaaagatgccacgcgaccaaagcccaccaccacaagtggaccaaaagcccacataaaccgagggtaattggaccgacccaacctgggcttcccacatgggcttaaacttattcgcgccttctccttaccaggcagcccatcagaataggccagccgcgtacattcccaatgctcagagagatggactattattacgcatcatcaaaatgttaaacgaccactttcaaaagaaaaaaaaaagagcattgtacttgtacgaacacatataccttcgttgcaatcacaaattcgcaatcaaaagatccaagttcatcacatggccaactgcgcgagagatgacacaacacggctgaaccgctaaaaaaccgctacgaaaatgttttaggatcatctgtgcattcttctctgtttaaggttggtaacagagcatgcagtgctaccttcgtctcgggctcgtggcacgaaccgccaaaaatcgacggcgatatcaacctcgttttgtttgtgaaacttgtatgtccgtggtaggttgtagcggagctggaacagagggaaatacagattatcatagcaggaacaaaactggaaacagaaaacatatgttttgacccgtaaagccttaaatgtagaataaactcatctagaaaccaatcaactttttgccggatttcaagcaaaactagaattgctagtcaagtgttatatcccggtatttcaaataatataaagaaaacaggtgcaaaaatggtttaaaaaatcataggtagctcaatatcgcatttcaccattctatttgcccagatttcctacagctagcaggcactgaatacatttggtcctccaaactttactcatacccaaatgtctgattcagtctaaatggaagcaagaaaacaaaaaaaaaattaacaggataatttatttactacttccccattgaaatactgaacaacatttttagggggtagatgcacaatacaaaatgataagcgcctagcatctatttagttacctcacatagaacctcggcacttatggcattgcagttgcgcaaggctaccttcttgatgtgctaaagatcagacacaaaaaaggtggacaaaaaatcaattaataaaacttccatgctaactacaagatggaacattgataaatatggttacttcttgttggaaatacactgttgcaaatagagaagggaataatcaaacatttatcatcagaatctaataaaataaaagagagattgtttctgacatttgtaatccccttgaggaacacttacttctctggtagaagtcttgtgtagcgaatagacagctcgagtggcaacctgcaaatagcaatagatattaaaaattttaaacatcatgcaataatctcagtcatgtgtatgatggcaactgctgcccagtgccctcaccttcatgcccatagaaatgaattccatgtcagctccttttctgcttgtcccaaagggaggattcatgacaacagtgtcaacaagaaggcctacttcaacaggtagctaaaagatcagggaagcttttcaatgttgaaagcatctacgcttatgtgtataaatatatgattttgtttcaataaccattcacattttttttgtgacactatattatctttcttgacctgaacaatggtgcacaggctattgaagtactggagagaaagtaaatagctgactcgtatagtagcatcagctaggatactactctggatatcttctctaggtgctatctacttatgtatgaaataacaaataaataacatgcaacagaaaaaaacagtgtgaaaaaaaaactatgagaagatcagaagcaataggttatatagaaaaataattaaaaaaaaaactgaactaaaggtgcacttaaactaggtagagtatgtcatcatttaaggacaatacctctcaaatttaaattctttatatcacactgaattaagtcgatatccagctgcacatcaaacatttaacaaaagaaacatgtcattcacatagtcaagtattgttactgatcctagaaataactatccctgtgtccaaaaatatagctgtttatggctactatattttgggacagagggagtgatacattaaatctgagtctctgctttcagccctactttgccaacatttgcttagccatgcaaatttgaccactaatactaaagaacatgaatagagacagagacagtaaaacctatatttaaaaggataatctagacagattagtagatcaattgaacagaacaaaattattgcatctttacaaaagaagggaagcatactaagccatttatgaaatttctatgatgcattgataaaaataatccatggcagtagtacatataaagaaatgcaaactgcaatatttgaatataaaaaacatctcagatgtggagaactgaaaacaaaaatcaacacctgtagtgcatttcagtagttgcagaaagctgatttaagcatacaactttccacaatgctatttggcaggaagacgccattaacaatttgcactacatacagatgagaactatcagaaaattatgactacaataacatgcatagtttggtggtgatgcaaggaggatgctggaaaaaggtgaaaacgagagggtacatagacaatgtgaagatttttcaacttcaggctaaaccaatggttatattcggaaccaaaaaaatgctatacctctagatctgcagcattttcttgagcaagttcaagggattgcgggtcaatatcaattccaacaacatgcctgtgatttcacaaccaaagggacataagattagaaattgtaactgaacaaataacaacaaaaggcataaagatactgagtgatgaacctcattttcttgtttctaatactaatcgacgagcacttaagttctgtaactaatgtggtgagcaagtggctaggtgaactaatgtggtgatttactgtccactaagttctgtaactgatggtatatcaacacacaagcatcatggacagatatacttattaggtaaagcttaaacaagggtaaaacatatccagacagcacaatcagtcaccatacagttctccattttagatacaaccattctccattttaggtcagtgagtgttaatatgcgacaatgtcacatgatgttcagtcgaattgaatataaaagggcaacacctttgcacagttaacaaatgatatctttacaaatatcaacacagaagaaaccagttggtcaaaagaaagaaaacccaaggatgtgggtgtccaaatcttaagatcttaaacatactcactcagcatccagcagagagcttgccacagacagggtgccacacccgcagccaaagtcagccaccactttgccagttatgtcatcaaaactattctccgcctgatggatttatggaatcactatgagcgagataaaaagcacaccagaacaacttgaatgttagcatctgaacagcgcacatgccagccatctactatttgtcaacttgatactgacaaaccacaaaagtagacattgccaacggttgcaacctgcaaatataggtgatctgccgaaacaccagaacctccaaagtatctacttcgatggacatcgccaaagtttacactcgatgatggcttatcaaaactaaaggctcgaaagaccaactacatgaataacaactattctaagaatttcaaagcactaagaagtctgaaatcgctacatgcctagaggaagagccactctactcttagccatgaacctactactgctggtatgctgcttggtcggtttggacatggaaccaaagctgctgcacttgacgtcgcccaattccactcacatcacaaaaggaagaaaaaaaacagcaggatcgtattcgaagaccaaagcaaaagataaaaaaaaatctacactctagtataaagcacaaaatcaaagcaggaaactacacggggaatcggaacaggatgctactactaccgtgtagagcatccgcgacgcgatgtgagggcccgttgcatactgctccagctccacctgcacccaccgaccaccaccaccaccggcggcggcggcagaaaaggtcagacatattcccgccaccactttgggcggcgatgcgaatcggaagacaagacgccggcaaagtgagtgcgcggcggcggtaaatttaccttgggtgcggtgaactgctgcaggtctccgaggagaccctccagctgcttcagcttcatctcctcctcccctcgccgccgccgccgccgtcgtcgtcgccgtggaagatggagctctctctctctctcccccactgccgggccggaggctttgccttttttcttagggccggcgcgggtgggaccgggagattgggccccatatggcccatctctaatgggccccgctacattgattgggccacgttgggtcttgggccggataggaaggcctaatacgagtgagtgggcctattacatcatggtcctcgtggataattgggccgataaaatgggccgcgtgggcggtggagtcgaaacgtcccgccgccgccgcggccgtcgactgcgccggcgaactccgcgttctccggatgcgccgcgccgcggggtgggggattttttgcgacgtggagttcgcgccgcgcgacgccggaggtgagtgctccgcccaccgtcgtgctctcctccgtttcgaactggcaattgataagctttgatgtctaggtttcggacggcttatgaagttgctgaactgggatgcgaccattttttttctccgattgaattttgaagcaattcagtgcaaaggtaaatggcagggatttgcaatttgagatgctaatcttttgtccctgcaaggtgaatttcgcaacatttctgtgcaaggtagtggcatgaatttgcaatttgatagactaatatgtgtccctgcgaaagttgaatagttgaaacaattttgtgcaagctgttggatatgctttggatcggtttggcacaaagtggaaccacaaattaaaataggtttggatcataccttgatctcccggagttcccatttctctgttgtttgttcttctttcttttcctcttgtttggaagcacagagaggagagagatgtgctatggctcttccctgtgttctcagtgggttgctagatcgggtagcgagagaaatctcttagggtttaatacttaggtgttgatttctatttatagccactgcacacagggggaaccgacactagtggaggcggtaaatcccccgatcagggactttcttgaaggggcgatcactgtagcgattgccctaaaaaatctttcttgccgactttggtttagccgcaagatcacatttgtgttcacagtaacacaagctagtgccatgaatttgcaatttgatagattaatctgttgtccttatcgaagtgtcaatttaagttttgaatggtttctttacctcaaaaaaaaaaaagtttataatggtttcatttacattcagtaccttggtagtacctggcaatattattggtcattgctcaagataagtgttgaaacatgatcatgtataggcttgattactgaccggatatataggtttcttggtctcatttcacaagtctttgcacaccttaattgagacgtttagtatatctgcatcacatggcatgtaatccagtcttactcacgactaccatgttgcaatgggtgggtatgccacgttttgggagtaatgcatgcttaattctctcttgcatgaagtaatctattaatgaaaccaaatgaggcgccttaactcgccaattaatggaaacattaaactctatttagtcgtggtgtttaagtttaagggccaatacgttcttgtctagatatattatgacatgttatgcctgtgtctcctcccctgaaagatgcaggcaaagaggggccatatttttcaatctctctccccaccccctgacttgagcttctgaaatccaccatggatttcagttgcttgcagccacattcaggaggttgtgatgatatgccatttgattcctatgtgcagcaaaatggccatcaggagctccatcttgttgatcatccattcaacaatgtcactgacggccatgaatactattctccatctgctggtggatcttttcttccctttgcaacctactatgatcttggccatgagtactaccctcaaggaggagaaaaggatgctgtcgtcgtcgatcgggcttcgccgactattcgtaaagcttcgcctcacctgcctctcttcacacctaaatctgaggtttctcatctcataggaggcggtgtcgttggatcatataaggcatttgagatgaattctaggcttatccggcgcaaaagggcttcgggtaagtctctgaagaaggctaatgttgtcaaaggccagtggacattggaagaagacaggtaaactaaactaaatttgtccatgcatgttctgtttaatttaacctctgtatgtccacctaaaggagttcatggttagtaggacataggattgttcatgttctccctagtaattgacaaatgtaaatgaattgattcttgcgaaatttaaacaggaagcttgtgaaattagtcgaacagtttggactaaggaagtggtctcacattgctcaaattcttcctggaagagttggcaaacagtgcagagaaagatggcacaaccatttgaggcctaacatcaaggtactctgtgctcctacattttgtttgtccaagtactgtttcttaatttgaaaaggatataatactgtctatttcgatgctttcagtgcacagaaaagaaaatgttcttgtgaataatgcccctgcatttcaatgttgttcgatatttccttgttttacttattgcttgtttgaacgaaattcctcaagaaaagccaattttgatacattcatatcaatgctaataaactccccaatacatttattctcccttcacaaccttgagataaactccccaatagaatactgtctattttgaaggtcacggaatctgaacgcaatgtgtaaagtaaatgtttgaagctagtcaaagattaaaaactggtctaagagagagcattgaatattgatttgaatacatttaaatcaatcctaataaaaaaattgaccttaaactatccctaaatattttcctatatagcattcgatcattttgattagcccaacattcacaagtgctcaaggacagtttcttcttgataagcagggagccaggataaggtggtgttctaaatagaaaggaagccacagaaattaggaacaaaaacgcttaggaagcatcacagtagatgagaattagaaaagctaaatatcattttgcaactgttaatatcaaggagaaaccaataaatctataagaacggatattcataaaaaaaattggcatgttcctttttaaaaataaaaactgacatgttagttttcatgacaatcacactttttatagagtttccatgcttggaataatccttctgtgtaacaaaaaaaaatgcagaaagatacatggagtgaagaggaagacatagttctaatccaaacacacaaagaagtgggcaacaaatgggcagagatagctaagcacctgcctggtagaacagaaaactccatcaagaatcactggaatgcaacaaagagaaggcaattcgcacggaggaggagccgcgctagctccaagaaccccaaatctggaacccttctgcaaaactacatcaagagccttggaattggtccaatcaagtcaagtgttcgtcaagctccaccagaatctactgcagtgtcatcgtcttcaccagcatccacacaaaagttagcagaggtgaatggtaagatcaggccagattccaacccatccaaccaaatggtcacccagggaatactcaccatggatgagaacagctacatccagaccaactcttgtgaagaactcctggtctctacctatgatgatttatgccttgatatgtgtgatcatttgttcgaaacgaaggacgagatgccgtaccaggtttacaacatagatgatgatgttgacatgaactacatcttcaaccacattgattatgctaacaagattggccatgagatagatatggaaatggcatgggacgatgatgtcctccaagacgatgaatcagctggatcatcaccattggagacaccggcaggtctagcacaaatcaataccgtgcatgtgaaggaggagatggatctaattgagatggtcacacgcacacaatcttgtggctagtggatgagaaaataagcagtgatgtaactatgtgtgctactaaatacacattacacgacctttcggagtgcaacctggggaacctatatggtgaagaaatattagaaaaataagaaaaacaaacatgtatgggttcgaacgaagcacttgattatatattatattgtaactaatattctaagtttttctcttcgtacttttggcatgcactctctctttaataagtactttatttttaccttttcttacattccaatttactcgttttatctactcacacttaattagttcatgctgagaaacaactagtgtggtatactcacatatattgaacacagaccaattaaggtaagaattaggcaacataattataagcatatatctaagctgacatgattagtggtcagttaattgtttacttcgtatttattaattagtaacaaaacatcttcattacatactgaattcagactaacatatagattatgttcttgcagcattcatcaatcaaaccgggatcattcctttgttcagttcaaaagagcataaacaaacgcactaaatttagcacacacacttaaggtaaaacccgcatgtaaaagagagcattacgtcaaacaccacatccaacataggagatgtccattaatgtgataagcaattcattcattggttgaggtgatccatgtaagcttgatacctgcatgggagagggaaatgacgacgaaattaacacatatatttaaaataaaaaaattggaccaatctaggaaggagtagattgattttgaattaaggagggggtgagactcaaacccggaccggctagttcgcagcttgcgttgctagccggaaagaccccgggcctttctccaacaaactccaacataaattaacacatatatttatgttaagtatctaacaaactccaactaaaaagaaaatgctttttaaagttctggacaaagttttagtacacatcatcgttcttcagtccctaacagtacgacgaactactttttttttatcttgccaaatttagttcattaaactctgagttaaacttgaagctagctagtactactaatttataatagtgccttgtctccttttgccccacaatataggaagcgaaacatatgtagctcacattgaactttgattaattagtgaatattgatttagatagttggtcaataacaaattagatcataacttgtatgagctgaagtatacaaattaccctatatgcagggaagggtcacaaattgcatgatggagaaactcttggttagcttcactagcatggccactgggccctacatcttggcaagatatatgaagcatattttctccactagtttcttgtatctgttgcaataaaaaagatttttagttaagctgaaagaactgcaattccctttttaagtatatacacaagcaaccgaaatgattcagatcacttcaatatttaaccatgaatttaagaacattatacatccctttgccttgaaaatttaataatattatttggactagtatattaatatcaaattaacagctatggggattcacagtaccactgaatttgagcaaggccattattaatttgattgcaccgtctatatttctttagataaataacgtgtaaccgagcagcaagggattattatattgctcatgtgagccttcagaacgacagcaatcggaagctagttcgagaaaagagtaattagtttcttaatttattagttggattttctacctcataaatacatttgatgtattaaataatacctctgtcacaaaatataagaatttttagggctggatatgggtattaaggaagtaagaaaattaaatcggaaaatgttgataagataatttagatggagaagttgttatatttggggatggatggagtatatgctaagagaaatttattgttcattcttattgaagctacaaatagtttccctcaaaaaaaattatcacatcttttttctatgtgtttgtacatgtaggatatgactcgatcgtaggcacatggaaattatataacatactcatgctcaaggctagcagctccggagagagagtaatataattaacgtttggagttttatcacatatggagtatatatactaatctgtatatattaccttcctttttaagtctttattagcatcttgaagttgttgttcctgcaaaacttatcagttattatttctggggactagatagtagtcaaaagattaacgaaaacgtacccataaaacaaagacagcacacacatggattaccttacgtttgagctcaaatacttgatcaagcaactgttgattctgtaaaaatgtatatacaaatgatttaccagcaaagtttgatcaagttaaaatttgatgtttcatgtaatacttgcgtaacaaaaccaaaaaaaaaaaacagagcataggtaatatataacatataagatggtgtatatgatgtataaagtactgtgtcaagcgggaatcaagctaaatatgcgtcgaaattaatatgattcatttcactatgtaattacctttgatgacctgatattcatgagggatatctcgatctggttctcaagttgctcgagctccttcaagctaagtggaaccaagtcctcgccaagaagatttctgcataagatcagagttagtccatgtgtgtaacatgtagaaaagctttctgagaagatcccacgtgcatacctctgagttgtttgtaggaactcaactcttgtctttaactttaagtactcttggtaattgctctatatgaatgccaaattagcagccaaatattaattgaaagaaaatcatgattactatgtaaaagttgatgagttggaatatgcctggcatagaactaattaaattggacatgagaaattaattaattaattaatagacaaaacttaaaatggtaatggcatatcatgaagtatatacatactgcatattgctaattgttgtgttagttgacaacagaacttatttgttacttcctccgttttatattataagactttctaacattattcacattcatatagatgttaatgaatgtggacaatgctaaaaagtcttataatatgaaacggagggagtagatatgtagcatgcatgcatggataatacttgtttcgtcctcgatatatacatatatagctgctgttcaaaaggggaatataccctgcgcagaatgtactgtaaaaatgtaatttaaaagacaagtctgtttaaaatatacattaattaacctatcatgtctagcatattatacatctatcatgcacgaacatgagaattatgtaaaattttaagatatcacatacgttttattaaatattatgtatggcagtgtacacatcgatatttccttgtaaacaataattgtagcccctatcacaacgtataccagattgtgttaattacataacttatatccaaaacaagcctgattctcctttattaacagctagcagcagttgctgcacagatagagatgattcattagatctaaaaatatgcttggccacatagatcctcatgtttcaactaatgaccaaattaagttcaattctttgaaaaagtttaaggaaccatagtttattacaggtgaattgcatatgcagcaatcatattcagaatcagatggttactagttcagtttccagtgcagcagatgcttcacatgagttaaggttgtagttgcaactgcggtatcgctccagtgtcttgtacatactgttacaaaaaagaaaatcagtggaccacaaaactattttcaatgcagtatcagttaaagttgttatattatattttgttgtttaaatacatgtatatacaacccgattttcctacatatgcatgatcagtttattttgcctttcataattaatggagcatatatcagttatattttctagggtatgtgcacagcgcaccctaagtttggagccagggttttaaatttcgaaagaaggatttctaccgcaggtgggcgatataaccaaaatttcagatttttttttcgtacgattttttttgaatttttgactgattttgaatggatttgaataaaatttgaccaaattcacaaaaatttgcaaacaaccgaaagtttcgggcgagatatgaacatttcggtgggggcgaaatttcgagccgaaatttcaaaccctgtttggagctataaacactatcacttacaaacatgtatatatttgattgatttgtgttaaattattagaaaattgtactctgtttttttagaaaaaaacaattgtaactaacattcagattttgtttcaaaataagtgcaattctaaaggagtgcagtactatttttccctacaaccacccccctcattcaaattatgatccctattttacccccaaccacaatttcactcccaatcattttacttcttgctaatttgtcttttaaatgctagagttacattattttctttgtggatactggatagaaggagtatattttttggggagggaaaaggagggagtacattgtgactaggagcttggaaaattcaaccaatccaaacttttggtacacaagtactcctactacataccctaacggtagggtagctagtaactgtgccttgtaaatcgacacaacctcgttccagactagctagcctgtactgtgcgctgacagaaaattttggcaatcgacacgcacgcctctcgcacgataagttgtttgcataccatatgacaatgttcaaatgatcaaatcaatctattcgcatcatcgcatgtgaaattatgaatcgcataggagtatgaaattacgaatgcagtgaattaacttgggtgtgtgtccggccacgcctagctagaaatcaattcgatctttcgtaccacacaactacaactaggctgtgtttagttcacaccaaaattagggtccctttgaatcgcaggattgaaaaaacgtaggaataggaaaaacgtaggattttggtaggaatgtaagtgtaaaacagaggattgcaaaacgcaggaaaaacacatgaatgaccgtttgattgaaccgcaggaaaaacgcaggaattagatgagagagatagactcaaaggaaagttagcaagaggttgaagctcttgctaaatttcctccaaaatctctataggattgtccattccataggaatttcaaaggattggataggattcaatcatttgtttcaaagggcttcataggaaatttttctataggattgaaatcctctaaaattcctatgtttttcctccaattcaaaggggcccttagaagtttggttgaaattgaaacgatgtgacgtaaaagttaaaagtttatgtgtgtagaaaagttttgatgtgatgaaaaagttaaaagtttgatgaattattttggatctaaacacggaccgtgtacatatccacagggaggataacaaccgacgagacgatcgatacagagatgcttatctccacgagtactcctacgacttttcctcctgctgctgcattactacttttcctcttgcttctgcagctgcaatcgcatgcacactagtacagccgagacatttgacaagacgtagagagagaaacctagctagagagaaagagagagagactcaatggaacagtggaacccaagaacaacccctatgttgcgagttcccaatggaacagtaaaaccagagcaagaaaccctcccaacttgccattggaaaagatgctcctaattaagatctgacaaaaataacttgccattggaaaaggcactgcagcctagtatatgtgcttgtgcaatatgagaattaagatgcaatatgcgtactagtagtactatatgccatgttcttgtgcagatctggaggggtctcatctacttcactctgaaaattgcatgcactaatgaaagagctagagagacaagcatggaagagatcagcttagagatatctagcatgcagctctagcctacaaatggaagcaagcatggagagattgcatgcttgattctgttgacagagtactagtctctatggcaactgcaaaccgtaaagaggaattaggggacggcaaacacacacagatcggcagccatcaggtgactagaacggctgtcctgtctctctttctttaaccaaaacaacaacaggaacaggttagttaatcagctatgagcatgtatatgatcacgatcgaggtggtaaaaattaactaaaatcaggatctttgagaaagattggtaaaaattccaacaaatacaaacgaaatgctggtatatatatgttttaaacacaaacaaagcagcagggaaaagactgggtgtaagaacttcccggacaaacatgagatgttaattaaacacacggactgatgattaattagaacatggtagctaggtgggcagtagctagcccagaaatcacaaggagcttcaaaaactcataacgagaaaactagtctttcttggctgcaaactaattaactaactttgcattagaattagggcgagatatatatgaattctctgcaaggggcgagagcttgcaagagagaattattagtagtaccaggaggaggtggagaactcgaagaggcggccgcgggtggagaagatgatgagggcgacctcggcgtcgcagagcacggacagctcgtacgccttcttcagcagcccgttcctcctcttcgcgaacgtcacctgccggcttatcttgttctcgatccgcttcagctctactttccctcgccccatcgatctctctctagctctctctcggtctcaaaatctcttcttgatctatctcctctctctccttgcctagctagttagctgcagcctgcaagcttccctctctctccctctcccttgcagtcttgctccgtttgttggggatggatggatcatggatgtagtagctaagtagctcggctagctagccatgctctcgtaccatcggctgtgctggccggagtgctccttgccttcttttctctctctctctctctctctctctctctctctctctctctctctctctctctctctctctctctctctctctctctctctctctctctccccctatgaccaagtcagtcacagtaagttgttagcttaattatcagccgtagctagtaaaatttaagtgtgaaatttaatcttacatttagttttaaagtttttttcaccgtagtctatttgattatcagcattatcctttaaaatgcaagatataaaatttcttaaccattaattaagggctcctttaaaataaatgattgaaaaatggaagatgaaaaaaacaagattttgaagatattggctctgttcggctgcactcattttcattgtgttgcagccaatcgtcacagtgtttttttttgttcagctgcagcagcgcagctgctaaacataaaaaacatagacagattgcaaaagttgcgagcaggtccattgtaattgcgaaagagagaaaaaaaaaacaagaacaaccatttgagtatgtaggccatttgaaaaacgtaggaattgaatgagtgatatagactcattggtaatcttttaaaaggttagagctcttaataactttaattcctccaaagtctctatagcattgtttgttccatatgaatttcaaagaaaatgttaagatttaatcatttattcgaagttatctttaggatttttttttcaataagattaaaaatcctttttttatgttttttcatacaaatagaggccttaattaattttacatgtaggagttattatttccactcaaacgatcggagtatccttgattctttggctacaactacctatatagactcattggtaatcttttaaaaggttagagctcttaataactttaattcctccaaagtctctatagcattgtttgttccatatgaatttcaaagaaaatgttaagatttaatcatttattcgaagttatccttaggattttttttcaataagattaaaaatcctttttttatgttttttcatacaaatagaggccttaattaattttacatgtaggagttattatttccactcaaacgatcggagtatccttgattctttggctacaactacctatatagactcattggtaatcttttaaaaggttagagctcttaataactttaattcctccaaagtctctatagcattgtttgttccatatgaatttcaaagaaaatgttaagatctaatcatttattcgaagttatccttaggattttttttcaataagattaaaaatcctttttttatgttttttcatacaaatagaggccttaattaattttacatgtaggagttattatttccactcaaacgatcggagtatccttgattctttggctacaactacctatatagactcattggtaatcttttaaaaggttagagctcttaataactttaattcctccaaagtctctatagcattgtttgttccatatgaatttcaaagaaaatgttaagatttaatcatttattcgaagttatccttaggattttttttcaataagattaaaaatcctttttttatgttttttcatacaaatagaggccttaattaattttacatgtaggagttattatttccactcaaacgatcggagtatccttgattctttggctacaactacctatatagactcattggtaatcttttaaaaggttagagctcttaataactttaattcctccaaagtctctatagcattgtttgttccatatgaatttcaaagaaaatgttaagatttaatcatttattcgaagttatccttaggattttttttcaataagattaaaaatcctttttttatgttttttcatacaaatagaggccttaattaattttacatgtaggagttattatttccactcaaacgatcggagtatccttgattctttggctacaactacctggaaatggattttgggcgggcccagggatagatgttgggtctcgcgctcggaggtctcaactctgattgcttttctcctttttaaagagaaaaaaatggcccctggtggggcccacgccatgcattgagaaaaggcagcgtgttggcgacgctcgcgattggtcgccggctacctgctcagggctccgtgggacccagcggtcgagcggcccacatgtcagtggcagtggggtaacgtagggggcacgtgtcgacggctcactgggctctcgagtctctgctgggacgatgtggaagatacgttcgcgtcacatcgctgctcgccgttcgtgaaaatccaatcggtattactacagggttttttactttttttttctttttaaaaacttatttgacatgtactctctccgttcctaaataacccaaaccctaacttcccaaggagtttttaggaagagaaacaaaagactacaatgcccttaattaatgtgaataatgttgtattaaatgatgggtaggtgaggggtaagtaggaaagaaggtagaagttggtttattttaaaacaaatttaaactatagaagttgatttattttgggacggatggagtagatcttaaaaaaacttactttagaagtgaatcattttcaccgcgccaacgtcattagtgtcatggtccaacatgccgacaccattcctctctcgggaaaagctaagtcaataatgtaggagtggtaaagttaggacggcgccaacaatattagcgccaagaacttatttgtaaaaattatatttaaaaataggttttatgtgtcggtgttattggtgccgaggatctatttgtaaatattttctattacaaataggtatattttctagaataagttttttcagatgtctatatgtaaaataagttttcagaaaagtccaaagtgcaaagatatatagatattactatctatgtttcaaaatataaaaaaaccatagtatcggatgggatacatccttatagatatgagacctatccacatttattgtattagctaggttatgtccaaccttattttagtttcctatattttaagacggaatgatggcttcaatttatggacattttgatccaaaccccagaaaggaagggagacaagaaacttttgttcttttgcttggcttaactctcccggctagatgaccggttggaaggaagctgaaagacaagaaacttgagtatctgaactgtgtatttgcacgagttaattaattattaacagctaggtagaccaaatgaagtgcagttcagctagctaggcacgcatgtttgtaacaagaattaattgtaatgatatactccgtccgtcccataatataagggattttgagtttttcttgtaacgtttgaccacttgtcttatttaaaaaattttgaaattattaattattttatttgtgagttactttattatctacagtactttaaacacaacttttcgttttttatatttgcaaaaaaaaatttgaataagacgagtggtcaaacgttgcaagcaaaaactgaaaatcccttatattgtgggacggagggagtagatcgatgcacgtctggtgtcattttatgtgttcattctgggaacatatatgatttcacatgtctgccattgaactcgcggttaggaataaccgaataaatcaataaatatttagtgaatacacaatataaaaaagaagtatatataggaccattttgtctttattaaaaaatgtgccctatcaaatatttatagcttcgaataagtaaacatgcatatttggattggagccaaatcattgtaactatactcaagcgcgacatttcaccaactcaatccagttagatttggcacactgcaatccaaacaaattaagaattctacctatgctaccaaataatatatatgtgacgccaaaccttacgaatgttccaaaggcactgtaaaaaaattggtacggtggaaaattgaaatggcttactgttacttttatggatgatgtacatatataaacgatctatacctctttcattacaaacttattttttctgattatattaaagaggtgtactacgtgcacaaattataataagggctgtgtttagatccaaacttcaaactttttccatcacatcaacctgtcatatacacacaacttttcagtcacatcgtactaatttcaacctaaatttttaactttaaaaggaactaaacacagccaacaagatagtgtagtatgtttgaaaatgccagtaaaagtagatgagttggagtagggatatagagcccgatggtacgtagctccatattgcaactacttctatctggcccccactgtttcatgtgctgcctacatacagttaataaagccggcttggccatgttgccattgcatgcgagagatgtgccccggccggcagatatagctacagtagctcctttgcccgacgcggacgcgatgcgacggctttgctgctgacgccacgcacctgacctgacctgacccatggccctagtgcggaccacgtgtcgacccctctgtggcccagcgaaaccatgccatgccatgctactgcccagcgcctgagtcacctggccccggacaagccggagggactcccccctctagatgcaagccagccgacccgccaaactagttagatcagaggattgaaaaacgtaaaaaaattatagaaatgattatttaattggtacaaaggaaaaacataggaatgttgagtattaagttaatagcaatcaaaatttgaataagtaagatcttatcttccaatagtgtcttgcctcgatcctacgcataggaaaagaaaaatgagctcaaggtggatgttaattttcctatgaaattcccttgaaatcatggtcataggaaatttttccatgcttttcctatgttcaattcctacaaatcaaaggcatgaacaataccaaatcccataggattcttattcctatgtttttcctctattttattctatgaatcaaatgaggccttatatgttaaataaatggtaatccgtgaattttcgaatcatgtgctatacctagaaatgccaatgtgtcaatacataaacttatttataaatcaaattagtaggtaacgtggttactgattaattttacctataaacaggttcatgggttgactcgcttacatccctactcccctccccgcgagggtagatacatgttagtccgagtcatccgacctaattaagcatgccctgcactctaataaggtgtttttttttctctcgcaaagttactaacaaactttgattccgaatcatagacttgttgcactgtaagctggatgtataaatgttcggtatatagatttctactctttccgtcttaaaatgagttaacttttttacacgaaacggttatcggaagttgatttattttaagaagagcagaaagaaaaaggaatgtgacgccaaagaaagaaaaccatacggcatttgcacaagtccattgcttcatcacttgcctgtaggcgctgcgactagtaggaccagggttttccataccgacaggcggcagtgtcacccctcctcacggccagtaagcctgttaccaagcaaaaccaaatactccgtccgtttcaggttataaaatgtgttgactttgatcaaaattaaagtattttaaatttaactaaatttatagacaaatatagtaatatttgcgttaacaaattagttttactaaattaataataaatatatttttataataattttatcttgaataaaaaatattactattttttctataaacttgatcaaacttgaataagtttgactttgatcaaagtcaaaatatcttataacctgaaacggagacggagggagtaatatttatcaaaagcatcaatttttaaactttgtcgatatagcgagtaggtgttgttacccaactttagcagtaaacccgattattgtttggggcatgctgtgcttgagatgaaggtcccagtgtcgattcgcagctcgtacacggcgtgcttcattttctttcatccatgaacacgaatcttgaagactgaagtcatgcataccaccgtgcacaaaggaaaaggtttttttgctactaattagatacttgggtcagtcgaaggcatttgttaagtcagtaggcaattatacttagtttaatttacactgttaagccaggtcaggcttctccgagtccgagaggaacatatgcctccattcctgcatgaccttgtcttcaaacatgctgtacactaacagagaactatctgaaactgaggaattgaaaaatgcaggaacggcaaattatctgaaacgaaatgcaaaaattgtgcaagacaaaggatcgagagaaagagcgaagctgcacagttgcacttgcacactttgcaatgaacttctggaataaatcttaacacagcctttaaacccaagtctgaaatcactacaaaagcataggaaagaaagtgatttctacaagattttcttctattcccatttgtgcagcccaaaaggcatatcataatcgaaaaaaaagttcccagaattcatctgctgaaaattccttcaaagctcctttggtccacctacaagtatcaaactggcccactgggcaccagcctgctcctgaatacctgaaccaataaccatcaatccatcatccaatttgcagcacccagctggtccatacatgcatgctggtatccgacaaaaggaaacatgtgctaaaatccaggtagtgaaaactgtgcatgaagctggacaagcagctagcatcatcatcgatcatcattcatcaatgcttaggtacgtcgtcctttcctttgcaacagaagacctgtcgccttgtgatcaagcaagtgtacatgaggcccctaccttacgacgacgatggatccaaccctcaaatcataaaagaggtaggagtaccttcactcaactacttctcctgatctgaaataaattcgttttagatttgtataataaaataaataaaatattgtcttttttcattcttcatagaaatgaaagctaaaatataccacttctgttgtaaaaaaagatgtcgtcttggagatgacacagttgcacatgtatgatactttctcagactgtatatttattaaaaaaaactaaaagagtaaatatattaaaaatacaacaagatagaattttcatgagaaatctgctaagataagtcccgcgttcccctaaaaagtgtaagtttcacatttttaaaccctgccatttctgtatatatattagtgatataagatttcaaaggtttcacgacatgcattctaggacatcatccatttgagaacagaaatagtttcaggctttcagctatgtttcctcattaactctttgacattttagataaactggccgatacacacaatcaaactcatggcactggcaagctggtatgaacataatcaaacttggataagattaagttcaaaggcagaagaacgcatgggatgcccttaggagtgataggcataccgacatagagcttttgtccttgctatccaagttaacaggttttacccaacactgcctttacattacatgctactacgaaatacatacctgaataaagaaggcataccgaaattgcatcagaaggggggatgtccgaatttacccaaatactatacagttgccaattggtaccacttgctcacttgcttcacacatggagggcagttggctacagcgacatgctgtgctgctggagccactcctgaatagcagaacgcagtgcgcgattcggaatgagctcctcatgttcaagtagcaagttggtcattggagacgtgtcatggccattgcagagccaactcctgattgcctcagcttcataggtgaatccatctgctgcaatgtgaggatcatccatgatatcctgaaattgtgaccatggtaggtaataaggtgatgatcagtcatcaagcaaaaactagaaggcagcatttttcagcaaaacaaaagaagtaacacatttggtttttaccatagatttgcacttcttcagtattattttctagctattccattcacatgtgccagaacaaggggaaaaatctggtgattgttttctacttacctgagatataggacagatgaaatatgacggtggactgttttgatcctgtgctgatctagaggatgaaggtgaagataatgcagcatcccttatagcctcaactattgcccacacctcacctgaaagatcagggcggcacctcctgcttaactcagtgcatctgagagcaaggtatgccagctgctcgatgtgcagatgaggccactctcccactgaggtatcaattactgagttcaagtcacctttctccattgcatcctccacgatattctttataccaacaggaggctttcctgttaaaagacgcaagactacaataccaaatgaataaacatcagactgaggtgtcaactctccagtggaaagaaattctgggtccatgtacagaggggtgcccacaggatgcatggtgcggtacagggtggtgttattggtgctggactggattaggaggcgagaaataccaaagtcactaagcttactgactaagttaacaccaaggagaatgttagcaggcttgagatctccatgaacaactgggtgaggtttattcttatgcagaaagattagtgctgaacatatctcagcaataattcgaatccgagcctgccacgtcagagtttgcctcttatctgaacacataagaaaatcttctaggcttccatttggcaggaactcgtatacgagtgttgaagactctgagcaagctcctaagagagtcacaaggtgagggtgtctcactctactgaggatagaaacctgcaagagaatccaaaagaagccactcaatttctacttctcattttgaactagagaggagccagagatcaactcccttttccagaatgacaaagataacaaacaaattttaaaagggtacactaattacctcttgttcgaactgtgattgtccctgtaaactatcaggtctcagcacctttattgcaactgtcatgttccggaggatacctttgtatacgcagccaaacccaccttctccaatcttcaatgaattactaaaattttctgttgcagattccacttcagatgatgaaaattcacagtgcatcgctgtaaccaaaactgaaagcatctgtcctcttttctgacgtagttcttcaacctctcgaactgcattatctcgttcacgtagcaattggtcatgctcagatagaagccattcaaaatgctctctggagtctgagagttgacctagtagattctcattctgctcattgactctctgaagttccacggtgacctcatcttgctgtattttaagttgttcaaactcttgttgtacccttgaaagagattcctctgtttctttcctttgttggacctggcttaaatacaaatcttccaatgtcctggcctgcacaaatcaagtagctgtcattcgtatcatttagacagataccttgatttatgacttcattcaatagcttgtgacatcctggattttttttttaaggaaaaaactgttactgaaaagtactttcatatggcaagtgctggtttgaatgcagagattgggatttggcaaattggtagtagtagatacagtggcaatgatctgctcaagcttgcctatttcttggaattgtagcagcaccaacattagatgtgaatgttgttttgcactctatagaatcaaatggtccacaacaagaaatgattggatgatgatacctctccggtcaagctaacctttttgcaaagataatcataataatgcactggctgtttagagaaaccgtaatgaatttaccaatcgttcagattcaatccgctttaagcgctcgtcggatgcttccttcttcaacaccgcagcttcatccatgcttttttgaagtttattacacagatcatcattcaaatgcaaatctccctgcaaggatcatttataagataatataatttaatagctagcagggttttgatgagcaatgcattagcatcacagaacttatttgtcagttttcactcataaagctacttcctaagcttaattatgcttgagcacggtgctagtcaagttccagaatccagatttgtaacaggtaatcatggatgacttgtttaaaaaaaagtaactaaactgaccagtatctctctcaagtcctctgctctagaatcaccgccattagctcttttaatgcatgctgcacatctacattgaccaaacacataagttacttgaaataataataacagcatcactgatgatagcattggactgaaaagggctacctccttaagccatcaagaacttcgaggttgtttgggtcacacttcaaaccctctacataagttgccagagcaatttcataattgcccataagtaactgaactttagctttacgcagatagcctttcagaaaagtaggatccaacgctatgcatttatctgcatcttcaagaccttcaggcaatgctcctaggtagatgtggcattgggctctgttgctaaaaacctgggcaatcatcagtcattaaaaggtataaaaatatcagtaccaaaactaaaaaggggcagcttgagatatagttttcactaagggaaaaaaaaaagcattaacttgttatacaaccagtgtaatagtgtaaatcaataccctgggatcttttgggttctttttcatggcttcagtatagtgcattgctgcttcctggtaccttttctgcttgaagaaatcgttgcctgcaacatgtgtacacagtgagaagaagcatacgtacattacaattgcatgacatacctagtgtattacaaactaggagctggttattatataatggttgaagaaaagggacccctatccaatttattgtgttactgcacttccattcatgaacaaccataacattttttccgcacttctctgagtctccaactcacaactgaagttagaattaaaactattgagagtgatattctactttaatagtatgctttcttcttgcaaatttgaagtttactcatggaatctcctagaactccagcctagagtacttgacagttgacactcaacggcgatgctttggagcaatatctgataatacagcatacagtcaacgaggtgctaggcaagggaagttagctggacacctaccttgtacaaggctacttctacactctttgcttttaataatggataggtagtgctcctgccaaattatttatttaaaaatgggtaaggatcctacatgaacaggaatagcatgtaacaaatgtgtatctgttccaattgagtggcaaattgacaattgaaacaacaccaacagcattagatgatcggtgcacagcaatcaatttctattttaatcttacacattgcactaatcgacaacaacacatagaaaagaacaacgtttcatctggaaaaaaagaaatgatcaaacctctgtctcggtggtgatcggcagcttcctgatcaagccgctcccgctcctcaatctccttcctggcttcctccgcctcgcccagcttggcgagcgtctcctcgctgtagtgctcggccagcgactgctgcagcgccctgatcgccgggtcgtagtccgcggcgcaggcggcgagcttgagcagcgccgacgccttcctcgccagcgcccgcgcgaccagcttgttgtcggcgcgtagctcccgccccttctccaccgcctcgtcgcaatccctcacgcactccttgtactgcaacggagaaaccaatcgccatcgccgcgaggttaaacaatcggagagagaggaggggtttgggggcatggctgagactgagagcctgaccttggacatgaggaggtaggcggcggcgcggttggtgaggaaggagatgtcgcgggggtcgaggagggcgccgcgggtgtagtggcgcacggccgtctcgaggtagagcttgcggtaggcggcgttgccggcctccttctcccgccgcgcctccgcctccgcctcggctcgctcgtcgtcctccgcctccattgctgcgacgcgcgccttctacgggagcagcaaatgcatatcggatcgccctcggcggcggtggcggtggcggtgggctagttgtcgaggggggatgaggaagaggaggagacttgaccgtagctgcattattgacgcggcggtttggcttgggcacggccgcacggcgcgcggccaaccggaacggaggaatcttctccgagactcctcagtcctcacgggtggtgtgtgtagtgcgatgccacgagtcggggcttgggctacgcagcaacctgcaggtgggctggggctggcttgcgagtggtcacctcgtgtgagggcacgtagacgtacagtcaatttctgatcaaaattttatgggacaattgcttatttgactctgttttgaagcctaactaccaatttgaccctactttttgaaaatgaacactccgtctgaccctgtttctacaacaccgttaagagttcatttaaaaaaagagaaaaaataaaatcacatttcataatgactaaaataccctccaactgtatcctcatctaacccttttctctcccggtctctctatcatatcctgcgagtggtcacctcgtgtgagggcacgtagacgtacagtcaatttctgatcaaaattttatgggacaattgcttatttgaccctgttttgaagcctaactaccaatttgaccctactttttgaaaatgaacactccgtctgaccctgtttctacaacaccgttaagagttcatttaaaaaaagagaaaaaataaaatcacatttcataatgactaaaataccctccaactgtatcctcatctaacccttttctctcccggtctctctatcatatcctgcgagtggtcacctcgtgtgagggcacgtagacgtacagtcaatttctgatcaaaattttatgggacaattgcttatttgaccctgttttgaagcctaactaccaatttgaccctactttttgaaaatgaacactccgtctgaccctgtttctacaacaccgttaagagttcatttaaaaaaagagaaaaaataaaatcacatttcataatgactaaaataccctccaactgtatcctcatctaacccttttctctcccggtctctctctctctatcatatcccttttctctccggcgagggagctatggcggggaaggtaagcggcagagccggctggtggagggagggaccaccggcggcggcggcgggccatggagggaggggatccgcgccggcgccaactcgcggagggagggcggctgcgccggtgtggatcggcggcggcgccggctgatggagggggggagcaccggcggcggcagggggccgtggagggacgggatccacgccggcgtcaactcgcggcgagagggcggctacgccaagcacggatccacggcggtgccgctggtggagggagggagcaccggccgcggcggccggccgtggaggaaggggatccgcgccgccgtcaacttgtagagggagggcggctgcgccgagcgcagatctgcggcggtgccggtggagtttcgacccataggaagtccacccctgccgcttccagcccgccagcgagggggagctcgttgtccaggccaggcagagcgggccgatggcatggctgacgccggcacaggcgctcgtatggagggaggaggtggcagcggcagcgccggatccgccgactgcagctcgagatccaccgcccggactcgccgccgccactcctcctccttgtcgtcgtcaccagggccggcgccggctcgccgtctcgactttcgccgcctctccctgtggtggatccgtggaggagaggagaagaactcgcagccgccactcctcatcgtcatcactagggccggcgccggctcgtcgtccgtctctccctgtgatggatccttggaggagaggagaagagagaagaaaggattggagaagatagaactgacggcagggtcccagatgtaatagggtcaaataagtaagggcagaagagatattttgggcgagacattttgggcttcagttaacaccattagacgcccttaacggaatagcgtcataccgtgtcttcaattttgaaaaggagggtcaaataagcaaaccctaaaaagtagggtcaaattggtagctagagttcaaaacggggtcaaataagcaattgccccaaattttatttatcgcttttgcgcatccgctttatgcacagaacacacaccacctttctcagaacgcaccacgccaccacctttcacctttctcctcaacggcaaagccgcctttgccgtcgccccgtgatcgtacaaagtaaaaagtatagcccactactaactctaaatcatctatagccaatataatagttaatttatacaatagttgcttactatacaattaatatctagtctcacctgtcatatacacattacgtgctggaatccgtgctacagctggctacaaatctgtagcccgctgcttttttctctgttactttatccctttaaaatatgtttatagctgacttatagcctgctattgtacatgctcttataaaatataaaatagaaaattaacaagcccttcaatataaaaaaacaaaggccttgttaactttgttactatttttaaacctaccaccatttaataataccaaattgtttggacgctttcagtttaatgttttaaaaacaattagtagtgttaagatttagtagggttgtgtcgacatggaaaacacgcaattttggttgttaacaggttgaaaatgtaaataactaaacatgcaaaaaaaaaagtaagaatgcatgtggactcctttgactgctcgctgacttgtgaatgcaaccaaaaactatgttcaaaattaatttatgtgtttttgtgtcatttttattttctagccttgtttttaagccgctacaagtagaagtataaaagttcaataccataataattttgttgcttcgtgtattttctctgtagtttattgttgtagtttaaccagtttgtgtaaaatatttccacatagtacaacgtattctacatgtcctcctccccctccccctcccccccaacaaaaaaaaagtgagctttttatattcttccactctggttatatgatttttactccctccgtttttttagatgacgccgttggctttttctcacatgtttgaccattcgtcttattcaaaaattttatgcaaatgtataagatataaatcaaacttaaagtgctatgagtgataaaacaactcataacaaaataaattataattacgtaaattttttgaataaaacgaatggtcaaatatatgagaaaaagtcaacggcgtcatctattaaaaaacggaggtagtatcatttttctataattttttaggctctccttattttgtttgactttcttttagttctttttaagtcagaggaagtgtcgaacgaggaaaacacatgagtggcagataagaactgcagcttcctgagactagagaggtagaatagatagtacggacaaatggagtggcaaaatcaagatttcccatttaaaatataacaaataattatgttaacaaaattacaacaaatactctatgactaatataataaattttaaatgaataaatcaacatactattaagaattccatgcaaaattagtgagaggttttatcaatacttttttttgtcttttaggttgaatttaaggatgtgtgcggtgtatgcaagaggttctgaattatacgcgacaaaatgggtcaggctgagtcgtgttggcccaggcatggttagttggtccaaacagaacatgtcacactcgcccctgcgggttatgctgacagtgacacggcatggctcggccattgcaccaaaatttcctcctatttatttttcattattccctcctttctctttattttccatttactatattttagaatttttttccgtatatccaaattttagatgttgctccctccgtttcatactataagacgttatagcattatccaaattcatatatatgttaatgaatataggcacatatatatatttagattcattaacatatatatatatatatatatatatatatatatatatatatatatatatatatatatatatatatgaatgtggatcatactaaaagatcttataatatgaaacaaatgaagtaatggatttgcttccgccacgtgccatatttgggtctatactggcatggtccatggtctttttggccatgcctaggtctcagcggtgggccggtgaggcacgacccattgtaggagcggtgtttttaaaagttgtgccgtgctatcggtgtgtatatttatatttagaatacaacttattatttgtgcaggtctacatatatatggtgaaaaaaagaaatacttcctcagccaataatttgacatttagcacacgattttttcaaacttttaaaattttagccatcaactttattatataaaaataagcttataaaatcaaataattttgcgatattatggtagcactttttagagaaatctacaggtattactccttttattttgaagtaaacatttacgaaatttggtcgtaattttgttcttgcaattaaatatttatggagcagaaggtataccgctataccagtactaggcctgtggactcggttgtgcggttgcaccggatattctgctccggcataaaatcaccagtacacacactccccgccggccgcggccaccaattagttttccgatggctatgtatgcatgcgcacgcggagctcgcgcgcagaggatcgatgctgccgaggagggccatgggggtggcgctcaccctcgcgctgaccgccatgtggcctccgccgcggctcgcggcccccgccactggtggtcacgtgaccgtcacggcgaggaagccgcggggtcggcggctcagcggtaaatccaccaccaccaccaccaccgcttcactcggctgcggctccaagccaaacaacatccgcggcgccaccgccgcagccggcggagggagcaaaatggaggccgccgccgccgtcgccccctccggtctccgggcgagcttcctcgacgtcctcctcagccgccgtcgtaacctccaaggtctccctgtccctctgttttctggattagtgcgctcaaaactacaggaatttgctattggcattcggattaggtgtgctgattaatgccttgggtttggatttgttggcggcagtggctctcacggtggagcccgggagcccggtgaagcgcccgctgtaccaggggaggccgccgatggggcggagcgaggtcaggatcctcaattggaacaatgatctatctgtctatcttgtgtttgtgtaggagcgtggtgattggtgtggcgttggttcttcttatccatgcgtggaaaatttcaggccatggaatcgtgcccgaggaaaggggtggtgaactccaaggagaagttggttgaagaaaatttctacctgattactgaggtacatgaccacattgctttcttctttgtgatgcatttgaagacatatggaaccatgtggaagccattttttatttatttgagctagccgccccaagagattgtggtagaacaacactaaaagtataatggattacaaaaggttgactgtgatttttgttgcttaaaattctagagagatagttactgtggttactgtctcaatatgtacctttcactaccaactctgttggataaatatctatgaaattcacgagtttcgcttatgggggtgaaaaatacatcgttattctgccacgattcttcctggaaaggctacacatggacaatttgatagtttatattatgttttattgtgacatccaggttcacatgcactcttatgtacctacattatataacctggaaggcaatgcacattggattcattcatcatctcatttcctaagtcagagaatttgatattgtttcccccaacagtcaggtgaacaagggcgtgtacctgtgcttcttctgaaacttaacgatacaacccctaaaagaaaaccagttattgtattcctgcacagctcatataaatgcaaggaatggctgcgtccactgcttgaggtaaatatctccttatttgttgctttagaaaaaaaaaagcctcttactgaattctgccacaatgctttggaccatcactatatcgtacacgcatatctattttgaatttgacggtttcccgtttgcaggcatatgcctccagaggctacatttctgttgccatcgattctcgctatcacggtgaaagggccaacaataacagcacttacatagatgtaatatgctgaagatcctttctatgtaccatttggttccatgaatgtttgaaaattccattaacacttattatttgacttgattcctgctttcatggttttaaacttaggcactaaaatcagcttggaggaatggggatgcaatgcctttcattcttgacacggtaccctacgttactgccattctgttatataactgatgactttgcccttcttaagcttgtcattcaaattgttaattaacctgtatatttgttaaaataagcaaatggttgtgtatccaaaatattaaatcagactgtaggatatgctgtaaatttgggctggtctgcctctgttcatgggttaaaagtcatggatgctggtgttagcccagatgaaatagcttcagcacgctctacttttcccttgaatcctggattttcaattttgttttgcttctctcaaacaattgtttctgatgttatgatctgatatatcatagtttgaacatgatacacagatgcagtgataagctgtcatatttcacgatagatctattttcaataatgtaccttaaaccagatttggacatcttcaggtgtgggacttgataaagcttggagatcatctcagtgaacgggaggatgttgatccctgtaggattgggattaccggtgaatcacttggaggtattgtatatcatgaattcatgattgccttatattgagctagcatatggactctgctgttactaactaatatgtaattcaaactgaatcaggaatgcatgcatggtttgctgctgttgtggatacacggtatagtgttgttgttcctataattggtgttcaggtatgctgtttcagttaaaatatatcgatgtggaaagaaagttttgtgggttgtttttagctatactccctgtgataactctagggatttcgatgggccatagataataacaagtggcaagctagagttgatagtatcaaacctctatttgaaggtgagactccactcataatctcttgcctatttgagaagttgggcttgtgccagtgaaataaatagactgatgttgaaatatattctcttaatttggtaaggttgcatgtaaatgtttatgtttcttttaccctgtccgttttctgcagaggcaagaattgatctagggaagagtgaaatagatacagaagttgtagaaaaggtgagtacttggatttattttactgttattcctgatgagtcctttatgagcatttcgttttcgttattgtgtgttaacatatctctgccaggtgtgggacaagatagcacctggtctggactcacaatttgatgcgcccttttcactccctgtaattgcaccacggccacttctcctcctgaatggtaagccaatcacttctgactgaatgcaaaatcagtatgactgactaaatgaaagctagttacaacattaaggtataaaacagtgatatttcaagattgttcgatacaggattcataagctgtaaaacagtgtctcacttttgaacttttccctttatgcattcaaccagtacccgtgtaagggttgcaaccttgagtgtgcagtacttttttgaaccaaagaaaaagtgtactgtccattttggttttgtgatgaagctaaaactgttgttatctattgataattcaaaaaagaatgttacttcgaatgtttcgtgctgcttgaacttcatttatcatgcaggtgctgaagaccctcgatgcccagtacttggtttacaggaacctgtttccagagctgctaaggcttatgaagaagttggttctgcagataagttcatggtaacacgcacttaaactgtcctttttgcccttattttaagatcacttatgaatccttttaattagcatttattaaaatgggattttgtttcaatgaacttagctttcaagcttgtttccttccttgtcagtatgaatggctaagtctaaacatgccagataatttattggtattatgaatctacaacacatctttgtgaggttggcattgaagaagtcttttatactgaaaaaaacaaagtgttctttcttctgagttaaagttgtaactcagcatgcacagcactaaagagcacagaccttcagcatctgataaaaagttttttataactgcactctataatatggttaaaaattattttgagcttaaagtcataattgagtaactttaaacaatagaagatgatgaaaatgacagaaatttgtgtagggaaattcaagaacaagatcacaaaacacagtttttggtgctgcaaaccagcagctttgctgattgtagattcaactataaatagaaatgattacaaagtgaaaatgacagtggccacctcgcctcctacttgcacgcgccacgacccattgccacatcgtgccatcccacgatcctgagcacgggacgcatgactcaatggactccgctcagacgcagcgtgcatcaaacccactctgcgcacttctgaaaataacccagccatgcactagaccaaaaacagatcaacgagtggagagaaaacaaagcgaaataactaaacttgggagcagctagagttattctatcagaaaaactaaatatgccccccccccctacccccataactgatgcatgcagattgtttttaaggtacagtatgttggtgcttgtttaaacaaaaaatatcagccttttacatccttactaggagtatattcatgtatgtaagctggcatattcttcgaaacaatttttcgggttcagtatccgtttaaaaatgtctctgctcccatcgcaaataaaaatcttggttcagtacatgattgattactgttgatagccaatagagaagtgaagtactgtgaggaacctgcttgaggtctggacctctatatgtgtttattatctgaagactgccttctgttatgagctaaataaatgctgctctggaactatggcttttatggcaatagggtgcccacatactggagtgcttggagttcaatactttaatgtagtaatcattgcctctgatgatggatggttgatgccttcgttcgtgtagattgctccaacctttgcatctcttccttttacatttctactttaagtgctttatgccaacaatttatcttcctcgtctatatgacaaacaactgatttggttgagcccaaagtaactggaaacttaagatttagctttgcttttaccattaaagaactaaaaggggaactgttgagttgctaatctatttctccactgttcagttcattgcagagccaggaattggccatcaaatgacagcgaacatggtgaaggaagcaagtgattggtttgatcgcttcctttagagggttatgtatatgttccgaatactcttattataccacatcgtgagggaaaggcatactctacaacaagttgtctcagtttataattgcttatattgaatatatgactggaatcgattcaatttcatcaccatctaatttgtagtctacataccctaataattgccaaaggagaaacattttgtagcatgtaggcatttcacagtttgagaatacagaagttgggaggaagattatttatctgtcaaggttctgatgagaaagactgatagtagactattgctctgaagtgctactagagcaaatctaaactggtacaaaattttgttagtgtgcacataaaaccatgtagactagagaattgaggcatcgtgatcaatagattatgtttggatcaattaaactatatattctgcagaaatattttatttcttgtttcttgcagtgtaacagaaagaaaatccccatgatcctgcttattaaccagtgtccagattcttgatgacatgtcaaccacgccaatcaagggctcaaggccagtcggtcccctaatctggtttacgtggacccaaatacccaataaagcatctcactatactggccatgtagccacgtgtgtagtgcgatgatatagaaccgtcgtttgcactttgttgcctgcaggctcgcatcctctgctagcaagcccgtgtccaaaatctgaatttaaattgattttgagtatttttcatcgttatctattctctagtcttgactttaaaccgtgaatagtacagatataaaaatttttagacataatttctgttttcgttcgtttacatttccatggcttatcagccatagctcaattaaaatcagagtataactcataaatcggtgtaaatgtgtaatgtgcatttctaggattgttgtactcttttggcagtcaataaaaaaatagtgagaaataagtgggacagcagtggcttttatgaaggttcgtgttataagtaccaaaatattataagtttataaccttttgaacccatttgagttgagatattcctgtagaattttccctaaatgtctcacagtttcatttcataatgcatgtaaaattccaagtttggcaagggtgtagggcagtttccagatgaccacatactactgtcctggcaatacaaagatttgctcttgggagtaatatacatgagaaaatatatttatcatgagaatagtgtggcctaaccaatgatcttatgatgccaacattccaacgttttccatccacacatgcatggtgagaaacactacaatattgtgtcaaaaataatatatgaaaaatcgaacggttgatgaagaataagttggcaggtcatgctcactcgttcttcctcttcttcggagtaggcgatgtgtcactttgaagcatggacgtctccgggtaacggacggttttcatatagcgtgttcgttgctaggtcattttccggctaaacttaaattaatttttttttctggaagagactattataatgttttctgtggttctgtgacgtccattagtccaaaaaattaattaacgatgtttgttggtgtctcgtctcatttgagctgaccataatatacgctgatattcttcattccgtcatccacctgtaagatgatatttcaaagtacagttacacatgctttttcattccggctacctgtaattcgtaagatgatattccaaagtacagttacacatgatttggccaagagatatggtcagcatatgggcatttatttttttaaaaaagaaaaacaaaaggtataagctcatcttatctgattgtaagttgtaacacagaagaggaaacacaaagccaacccaacaagaaggacacatcaaaatttgaaaatgccgcgacccaacaagtaaaagggtaaacatcaaaggtatataaccatttttttccttttcttaatattaaaaggctacaatttggggctgcactaatccatcccgaatttgttagaaatacattatgcgagaattttccatattataaactccctccagtctagttctctagatgtcaaatatatttaactagagtttcttttcttctgaacaaacattagaccttgcttggaatgggggatatcttttctcgattcctatctgtttcagtagacagccctatgctccaagctgacccatgcccttcagcccttcacagagccatcactacacgagtttaattagcatctatcttttcagaattgacttaactatatatcgttgttcttctgtacctctgaatttctctgctaattcccatcataatccatgctgctgctgctactctccatgaatccatgatgtttttgagccttactcatgggagatacaatggcgttgtgtgtgtgtgagagagaaaggggcatagtctggatcgacaaaggtacaaacggccatgaccgacacacaacgatagcaaaactttaccaaaaaaacgattccaaccaggtaaagacgttcacatatcgctggtacatgattattggagtttattaattggttcgtatcaattcacggctctattttcacgtaccagcaaaacagaaatgtggtacgctttgcacatgcgatctttcaaaaacactatgcacacatgtgaactgataaatggccgtccaaatccttttagagagaggtgtccattcattttgtatagacttttttagcacaatcaactgaattgccaaaaagtactacttctatctcataatatatcaacataaaaccggattgaacacaatttaatagtattagattatatccaatctagttttaagttgctatattactggatgaatggagtaattaattagttaagcaaatatatagaggggacaaatacctaacagaaggaagctattgccggatagagaattcttgcaattaacaaccacccaaattatttgtttcttgtttggttcatgcaagcatcgtgaacgggaatacaccctttgcctcctttccatccagcttgtccaaaggaaacatgtcaacttcatacagaatcagacgagtagcatgcagtccctctcagcccaaatctccccatcgtattcaatcgtcattcttctcaccattaatttacctctgcattacatgcagatgctcttctatgtataaactacctgaatgcccatcctttactacggataaagaataagaaatattcacatcgatttgattttatacgtgactatctaaattgatttttaatagaaaaagtttcgagggatagttttaaaactataatgggagtatgtgggtcaacagattcactgttatcaccactatcttcctttgaagtgtagtagtataaatacacaattgctcatactcatctcatcctgtcaaactaatgtccaaattaaattaggtggcttggagtgtaagactgtactaggcattaagtagattgatcaagtaccctaaagattgaaattaaggatatgacacccttaaaatcttgggcatagtactcttatcatgtactgtaccacagttgtgtttgagtacaaataattcacaggagttaatgctctacattaaattcaaagttctcaatatattatctcaaattcttaatcagagccctatcagtcgatttgtcgtttaatttccaatgaattttgacaacatttcaaacaaaaatgcatacctcaagctggcttgactcgttcaatatcataaaattcgtcgagattatgaacgtttggttgactgctaatggctaacgttgtcaaatctcaccttagacaaggtacagcttgccgtaaaaagtgtggctgggaccacacattacacaatctctcgcaaaaacatgtctttgatgtatgggaccttgtggttgaaaaatacggctaatcgtaataactagaatagtttcgtaataaactatgacatcaatgaaatggttaggtaagaaaattatgtccgtctaaaatttggcttgataattggaggcatccagatagatacccctaaggaaaaggaaagagaggctgaaatgccattaaaaaaagtgactcgcggagctgatgatccagagtgacagacagtggatgagtggagtggaggtataacgcagacggacattcccttctcctcccaccccgtcgctgccgacactccaataacccaaacggcgccgtcaaaatcctaacaactaaaaatcccatcccctactcccgcccaaaacaccaaccaccactccccccacacactactcccgccacgtggcacgctcccactggacccgccgtttccaaccgccgcagaagatcccgcgcggaggttgccgtcgcgttactggccttcccttttagtgccccccccggacacgagtgctcgcctctgccgcgcctgcgccaccaccaccaccgttcgtccgctcgccgcgtcgacgagctcctcctccgcttcgcgcttcgtgtcaggtgcgtgttccagcgccggatcgtctccggcgaccggttcttgcgggagttcggggctcgcgatgatcccaaaaccccggggagatgtcaagaacaccgcgtcttgttttttttctttttttggttgtggttttgtttctctctctctctgcgcgtctgatcgatcgctcgcgtgttgatggtttcttagggtttggagtggagtggagggggaaggaaaagggggagggatgatgcacgcgaagtcggagtcggacgtgacgagcctggcgccgtcgtcgccgccgcggtcgccgaagaggggcggcggcgtgggcgtgggcggcgcgaactactacgtgcagagcccgtcgcgggagtcgcacgacggcgggtacaagtcgtcgtcgatgcaggcgacgccggtgtacaacagcccgaacgagtcgccgtcgcacccttcctacggccgccactcccgctcctcctccgtcagccgcttctccggcaccctccgcgacggctcccgcaaggccggcggcgagcgcaaggcgctcaacgacaagggctggcccgagtgcaacgtcatcgaggaggagggcccctacgaggacctcgccggcgacaccggcctctcccgccgctgccagatcgtcctcggcttcctctgcttcgtcctcctcttcaccgtcttctgcctcatcatctggggcgccgctcgcccctacgagcccgacgtcgtcgtcaaggtatactactgcattttttatttttttgcattaatttacttcttgaactgatgtaatgtctctacttaatttggtttgcttcccccaattcacatcgtggattgaaatgccaagtatacttaattgtgatgtttgtgtcgcagttgcagtttgggtggaaacgggtaaagctattgaattgattggtggtttggtttgacactaatttggaagtgatgaggaataagaaaataatgtagtttgtttactggttttacatttgtttgattacagtttacaggttgctctaactagatggtaaaaattgggaataaatttggttggtagataggctttgggaagaatagcttcattgaatatacaacagttcgagttgttgcttgttttgattgaacctagcacatcagcatatgtgctttactctctttgtggttgtgaaaccaagttataattgtttctgtataattagaattctatagccgtaaagtatagaaaagtgaaaacaacagaagcagctttagtctcattttatattagtaataaaataaatatattaatagaaacaaaaaaaaatgacccaagagcaaactggtttcttattgttccctgtctgatagagatgtcgttggctgcaggcctgcacctgcattcagtatgtctgactgtttgtttcatttcctgaccgttgcccactccttcaataaaaatgaaatcgccatagagtacttaacatacatttgtattgtccagtagtttggcatggtaaattcttcatgttgctcaaaagattttcagaaatctgaacctgctggattcctcaaatgtgttctagccaggaacttactgtactttttgtttttcacagagcttgacgatggatgatttctacgctggtgagggcacagaccacagtggggttccaaccaaattggttacactgaactgctctctgcacatagctgtatacaaccctgcttcaatgtttggaatccatgtcacgacgggtcctattcgccttctctattcagagatctctatcggggttggacaggtatatctatcaacagtcattgtttttttttgtaatacttgttagtgctggccatgtctctctatcacaccttatttttctttgagagaattctctatcacaattattaatgctgtcgataaattgtctggtaatgctaattcactttttaccaaaaaagtaaactacattactgaatctcctcctttgcctctccctttcaccacacatataaaagctgaattcaaagtatttaatctgttttctctgctgctttcaaagcaatgtattagtggaacattttcttgtgctctttctctgcttaatccatttctttccctacgcattgtatcaaaggtcaacaaatttcaaactttcaactaggcaaacagttatttttgagtcaagtgggtaaaatactaaagcatatcattaccataggggataaaaaaggggaatgaattattacggcgatgaatattccgtacagtttcataagacaacaaaacagtacgataactggaaatgttttgggaaacaagacaatgagaaacggtccagagattcttctgttcgcactgtttatctgaatccatgcttgcgtttcatatgcatgcagtacatttctgtcttttaatggtttacccagaaccaagaactcatgataaggcctggtttagttccaaattttttttttcagaattccaactttttcatcacattaaaacttttcctacacacatcaattttaatcaaactttcaattttggcgtgaactactaccagcccacaaaactaacagctaacaattctttgtaatttcaggttcgcaggtactaccagccgaggaagagccaccggttggtgacggcggtggtccacggcaacaaggtgcccctctacggcgccggcggcgggctgatgctgtcgagctccggcggcgcggtgccattgacgctggacttcgacctcacctcccggggatacgtcatcggcaagctggtgagggtgacgcacaaggtgcacgtgacgtgccccatcgtcgtcgacgccaagaagacgaagcccatcaagttctccaagaaggcctgcgccgtctacaagatctgagaggccatcgtcgccgccgccgtcgccggtcgtcgtccatcacgccggcggcgggcgtcgcctgcagtgatcgatcggcgacggagccgttcttctgttcttgcagttgttgtatgtattatgcttgtgaagaacaataagcgtttatatggtcacttgttaattttacttgagcttcgattttgttgataaatcagtaaatcactttgtatggtagtagtgttttattttctctgctttctttctttcctgaggaaactatgtaccgaagtgtggtactagagtcagtctagatggttttacgttaaagatcaccatgtttacagtttcgcatggacaatcactgcattttgttttgaacagagcatattaaacagcaagcaaaaatcgtgtttcttttcacctcaagaaatggtacaaacctgtctttcaaggattaataatcttctatggcactgaaattttgcaaattatttcatgtcaaaaatataatgtgatattagtaaggttttgtgtaatttggatgatccttggatccagcgcccgttgactccccgtatagacaagagaagtgctgagctgacctccgagctcaaatcacatgcaaattcggctcccaaactttgcttaacccttaatcacgcggtcacgatccaaaccccatgtgcgtgcgaagcggccgacacgtctatccctcatgtcactgacatgtggcccccaccactcgcgtggccccacacgtcagtctccgctctccccccgtgatcgccgcggcgctctcagtctcatctccttcgccgtttgaacaatcgagagctcgccatttcttcgatctcctctcctcttctcctccacctcctcctcgtggcttcgcatcgcgtggagctcgtagtgtgctagatctaggaggaggcggcgatgagggcgcggagggttgtcgcggcggcggcggtgctgctgctgttcgccgttgtggcggtggcgcggctcgacctggacgacgacggggacgactcggaggtgctggacgagctgctcgcggtggacgaggaggaggagagaggggagctcggtggaggaggggaggcggcggcggcggaggcggtgcggcgggcgcagtcgatggtgctggtgctcgacaacgacaacgcgcggcgcgccgtggaggagaacgcggaggtgctcctgctgggctacgcgccgtggtgcgagcgcagcgcgcagctcatgccgcggttcgccgaggccgccgcggcgctgcgcgccatggggagcgccgtcgcgttcgccaagctcgacggggagaggtaccccaaggccgcctccgccgtcggggtcaaggggttccccaccgtcctcctcttcgtcaacggcaccgagcaccaattcactggcctccacaccaagtgaggatgctgcccgttgtgtttgccatttcgttctagaagctgccgttaacgtgctcgatgaattgactatgggaattctgtctttgttgttgatagggacgcgatagttacttgggtaagaaagaagactggtgcaccagctagtaggattcagtcaaaggattccgctgaggaatttctgaaaaaggatcaaacttttgctgttggtcttttcaaaaattttgaggtatgttagttgtctgatggatttggatacaagatatatatgctctacgctaaatataaaagcttgaataataaagttcatagagtttgtttcattacatttagaggttattcacccatatccatcttttttgggggcagggagcagaatatgaagaattcgtgaaagcagcaacctcagaaaatgaagtgcaatttgtcgaaaccaatgataggaatgtggccaaaattctttttcctggtattgcatctgaagagcaattcctgggccttgtgaaaagcgagccagaaaagtttgagaagttcagtaagtttcttctatattacccattatagaaaaaattctttggatggttcacttcacccctttcattttggtcttttagaccatagtttgatgagtaacttcccaatgaaaagccttactgaacactgaaagatgatctttttcttctcttatattttggtatttatgtggtacaaagttacacgttggataaacaatgctgttcaatgtagcaatcagattttagttggtgtatccaaaaagtgatataatggcatttttttgcagacggggcatttgaagaaaaggagataattcaatttgtggagcttaacaagttcccacttattactgtattcactgatctcaactctggtaaagtttatgggagccctattaagctacaggttggcactctctgcttttctcattgtatgaacaagtggaactggatagaagtcatatttctggaggatcaaaggatgcaacaaactatgtagttcaaataagggaaaaataataatccttgatgctttttataatgatatataattagatggtcttgtaaatttgttataggtcttcacctttgcagaggcttatgatttcgaagatcttgaatctatgatccaagaggttgccagaggattcaaaacaaaggtgtgcactgctgctttgttcatttctgaggctctgagccaataccatgtcacctgcatcactgcataggctgaaactgttttctctttcactctgcagataatgcttatatatgtggatactgctgaagaaaagcttgctaaaccattcctgactctctatggactcgaaccagaaaaacctactgtaagtttgtttagtattgaatgatggatctcattctagagtcaagtttccattattttaactttttcctccagtagatgaaggagcgcgtatgtgctcatatatatatatatatattatgaaattaggtatatccatgaaggttggatggataaaatagggatggcatcaaatcgttgcttacttaaaattattgtttcattgataataataaatattgtgctaattggtctgggcacactcttggctattgttacagtattttgtttctctgttatttcacatgatagacttattgctaaaacaaaaaaaattcactaggtgacagcatttgataccagcaaaggtaccaaatatctgatggaggcagaaattaacgcgaagaacctacaggttcttatttatctttttcgttttatgctacatacttaaacaagaccacttagttgtatcatgaactggcaacaggacttctgcttaagccttctggagggtacacttccgccatacttccgatcagaaccagtaccagaagaagtaaggattaattttgttaatttcgcatcttgctgttcaatgtagtatgcaccagatctttcaatgcattatgcatcagagctgaattctttgcacagcgtagcttagagataaccatatgttaagggtgcagcatcttaagcacgatttactttctgaaatgtttacagtccacattttctttgaacaatctttagaatttttggaaaaaatatccctcagtaatatcggaaagatgtgcgaattggaaacataacatctaacattttgataactgagctatagttcaaaatgctctatatactgcatgtatgctagtagtttgggttcactaccagttactccatgacctgtgttcaagtataaagcagttactactttccatgttatatgagtttatcacaagaaagaacacaatgacatgttttttcttgttaaaattttgtaatttgtaattagaatgtttcatcctcactcaacattttgcagaagggacctattgaaaaggttgttggccgtacatttgattcttcagttctagaaagtcctcaaaatgtgttccttgaggtacgtgaactttatttctggtctcttttatggccaggtacccatcatttctacttatgaaaatattgactttattctttccgagatcttacacccttttttcccctaaaaaggttcatgcaccttggtgtgttgactgtgaggccataagtaaaaacgtggagaagttggccaaacatttcaatgatttgggccagactaatcttaaatttgcacgcatagatgcttctgtgaatgaacatcccaaattgcaggtaaaccagtctttgcattaccatcatacaccgtatgccagtagtacagacattaaatgatgcataccatttcagtgatccatttactctaatgcactatcaattttagagcagttttattattgcaattgcgatgtagccacttcttaaagaaaacataaattcttgtgagatactttatgaatttggaatgagatgattctatggttattctgctacacaagcatataactattggcaaaaaattaattacatacaagaaattgtaacctcaaatgtttattagagaatgacatggttgcatgggtattacattaccttgcatggtagtgtcaactgtgaagttcgtctgttcactgcaaatgttcccatgctgaacttggtaaagtaagacatggtttcattattttccaatggcaatatgttgaagatcagatgaggttttggtgagcttgatggcacctgtgactgcacatttaaactactttccggtagaatagcttaaatggtggattgatattacttaacactcagtaactacgaatctcttagttaattttcttgattactggaagcatagcatgttcctttatgcaatccaccatcacaaaggtatacaatttcccttacaattgtccattcctccatacagataaacaactaccctacactgttgctatatcctgcccaagacaaaagcaacccggtatgtcctctaaaatggatgtgagcttactgtaagctattgtcactacatgtgctaataacatactttcaaatgcagataaaactttcaaagaaatcaaatctgaaggacatggcaaaattcgtcaaggagaagctgcaaattgcggatgtcgaaacagtagccgctggtgacattgtcaaggatgagctatagtagatttctcacagctttcgggcatgctttgtgcagtgaatgaaagtaacagcatgcttgcattttgctggaatgctttcacaccatgcttgtcttgggttgcaatgtaccatttgagataaggaaatagaataggaaatgatcaaacgggtatttaagttgaactatatgaccttccagatttacttaccgtcgcagcatcagctgttccttttaaagatgtgatttactatacatgttattagttgttgataacaagctacatttgtttgtttgttgagctgtgacttgtagcattgttctgtaacataaaactacaaattctgtccaattttgtatcctcctttctagtcctttattttgaaaacgttgggcaaacaatccttttgctactgaaaggtctcatgatgacagaggcaattttttgaccaagaaaaacatactttacctaattttcccaagtatacttaagtgtggaaaatgcaggaatatctcccaacacgaaataaaaagctatatgaactaactattcgccaaagtaaacatgaacgaatgaaaaacaaaatttgatttgaattgtagggctttactctctccgaagagagagagcccttccagaaattctcagtggcccgggtgggccaaagagggggtttggaaatagttttcaaccagcaattgacgcgcctcggtataacctcataagctgcgtcattgccccaagcgcaaagataccttcaaacgtttgcccccctcccctctttatacccgcagacctcccgcacatctccctcgacagccgaggtggtactaaaccaaacatggaaacacgaaccgccttaactcgcctgggcttttcttcccttctccatgggcctcgctttctccgtgtgggcttccacctgcgtttccaccaggcccaaattaggactaatcaaggaattattacctcctgtaaataattttaggacaatctcggtgaaaaagcgatcattaactgcgaggtaaaaacgctgaccccactagcgagtgattttctctctccgtaacactcgaagtagtagtggtagtcgagttaattacgttttgcttctctctttctcgtttccggcgaggcaaaacgggcgggggcgcggccgatctccgccgcgcggcgcggcggcttgatctcggatggcgctggagaggcggctcgcgtacgccgcgctcatcccgttcctccttctcgcgctccccatcctgccgtccgattccccgtccggcggcggcggcggtggcgcgggtgggggtgggggagggggagaaaccctagacccgcccgcggcgaagtacgtggtgcggttcgtcgagtaccggcccgccgacgagcaccgggagtacctggaggacggcctccgcggggccgcgcggcctccccccgccgcgtcgtggcggtgggtggagcggcggaaccccgccgccgcgttccccaccgacttcgccgtgctcgagatccgcgacgcgtgccgcgcggctgtcgtcgacgccgtcagtgcgctcggccgtgtccgggacgtgcacgccgatgcgagctactccaggggcgtcctgtctgcggatcggccgcggcagcaggggaagctgttcacagccatgtcgttcgagggggaggaaggagggggagatagggaggtcgggtgcagcactgatagtaataattcctcttctgctggttggaggcggaagcttctcgtgcaggtagacttctgctactcagaatctccacgtgatcatttttatccattttcgtgtcaataatgattacatgcaattgaaacataatgtattaagatctttacatctatcttcaagaaggaataaacctgtgaattgtattgaagatcaccatatatatgttttgatgacaaatttgtcggaaactgaaaaaagaaaaaaacattggtattcaggcaaaggtatccatgtattatcctcaggtagttagtgaatatgggttcaaaatatgagccttatccatacaaaccagaactggaaattgatgtactgtgtagtgtattagtgtataatctgctactctgcttaaaattatagcatgacactacacagcggatacaagatgccaagacacttccataagaacctgatgtgtaacatatacatccatgtcaacagttctgtccatgtgaagttatcaggttgtatgctagaatgttttagcatgacaaggtaataacatgtgtccttttacagagatcacaagtaacgtctctttttggagctgaacgactatgggggagaggtttcactggtaggaaagtcaagatggccatttttgacactggtattcgagcagatcatccgcacttccgtaatattaaggtataatatgatgctagtaaatatcactgcctgtgattatggtcaaatacacatgcatacaaaggaaaaagaacattggtttggaggggaaaacagaacatgcattatatacaacttcatattctttatggtgtttccttcctggtctcagatgttgtattaattattgtcaaattgccatccatactgtaattgggattccttaaaagtatcactattgttcctagtattgcaaggcaagaacacaatgataaacatgtattattatcctaaatgttgcctctccttgcctcctcgttgtttgttatccccatcacacttcttaagaaactaatttttgtaggagcgcactaattggacaaacgaagacacactaaatgataaccttggacatggaacatttgtagctggagttattgctggtcaagatgcagaatgccctggatttgcacctgacactgagatatatgcatttcgagtgttcacagatgctcaggtatggacttggctgctatacatgaactatgaagcacaaaaaccagatattctttccctgtcaatttaattcattctttaacctttgatattgcaaatggaataagtgtttcccaaaattatggaaatccacctgtaacttttaaacttttagaacatagaatttagaagcatatgtgtgctgttctttctatatatgagcataatacattttaaaatctctcagatgccttttatccacgatgtgttatccacggttaaattttatttacgtgtttgaaagcatatacaccaaactgttgttagaacacactgctggtaagattttgagaattctatcttgttctcagtgcagatatcctacacatcgtggttcttggatgcatttaattatgcaattgcaactggtatggatgtactgaatttgagtattggtggacctgattatctggatctcccctttgtggaaaaggtagagcaggaggataactttcttcatttccctcaatcatgttcctatttgtactgcattagaatttgattttgtttaaaactagaggtcgttactgtaggaataagtcttggctggttggtcttggtcttgtggtgcctttttcctgcttttcagctttctaggacagcatctctttctaggacagcatctctactttcagtttgagatgctctaggacagtttgttgggatgctctgctctaggacagtttgttgggatgctctaggacagcaccctcttagactagcatggctgcatggctgctacaagcagctataaatatgtatccaatcctttttgggaggatatggcttttgtgtttagtgaatgaagaaaaccagaaaattgccccatctcgagtgccatcctcttctcaatgagagtaaccattgaaattctaacatctggtatcagagcaacactttcctgtaggctaaacatctcttgttccaccccttcccaagctcggttgagctctcagccagcagcagcaccagttgctcctccttcccctttcccttccccctctccacgcagcagccccccgcaggtgcgccatgtccgacgctcggtctcggcgttcggacgcctcgagcactcggcgtcagcaggacgccgagctcgccgcagcagaagagcgcaggcgagcaacagctcagaccgctgcagcagcagcgagggcggccagactggcggcagcggagttggcagcagccagggcggaggcggaggcggaggcggcgaaagatgcggcacgtgcggcggaggtagaggttgagaccttgcgcagcagcatcaacggctccatcgccggcgacatcaccgccgacagggagcttgaggagctggcaagaggaagggcacgggagcgggcagagcggtgggcagcagcccacctccacggcggcggcggcggtccaagggaccgcgggcccgccaacgggaacccagatgggcgcgggcgtgccggcggcagcccggagcccgcacgcggccctcgcaggcagcgcggctctttctcccctgaccggcgccatggtcaccacggcgtccagacggtggtcagggactttggtcccggcggtgggtggcctaccctcaccaaaaccaactacatcgagtgggccgcagtgatgagggtgaggctccaggtgcggcaaatgtgggaggcagtccggtacggcgacgtcgactacgacgaggatcggcgagcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctatgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcattgccactggcaaccacaagccggcacgagacgacgcctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgacctgccgacgggagttcttcaccgagttcgactccagcgtccgaggctccgtcaagttcggggacgcctccggcgtggagatcaagggtgttggctccgtgaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcatggcagtggcacgagcgcttcgggcatctccacttcgaggccctgaagcgcctcagtgccaaggagatggtgcgaggcatgccgtgccttgaccacgtggagcagctctgcgacgtctgcgtggtgacgaagcagcggcggctcccctttccccagcagacgagcttccgagccaaggagcggctcaagctcgtgcacggggacttgtgtggcccagtgacaccggccacaccaggaggacgacgctacttcctactgctcgtcgacgacctctctcgctacatgtgggtgatggtcctcggcagcaagggagaggctgcggatgccatcaggcgcgcgcaggccgctgcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggggatggctcgggctcttctcaagcagagggggatgccagccatcttctggggggaggcggtggtgacagccgtctacatcctcaatcgctcgcctaccaaggccctcgatggcaggacaccgtacgaggcctggcatgggcacaagccggcggtctcccacctacgggtcttcggctgcctcgcgttcgccaaggagctcggccacatcggtaagctcgacgacaggagcaccccaggggtgttcatcggctacgcggagggctcgaaggcctaccgcatcctcgacccggagacacagcgtgtgcgcactgcgcgcgatgttgtgttcgacgaagggcgagggtgggtatgggacaaggcggtggacgatggttcgactccgacgtacgacgacttcaccatcgagtacgtccacttcgagggagctgggggagtaggcagctcttcatctagcgtgtctaccccagcccccgaatctccaccgactccgacaccaacacaccctcgggccacgacttcgactacgacgagctcttcgtcgacaccaccccagccagtgactccacatgctccagctccaacagccactcctccaagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggcgaccagttggtgccgggactggtgcctcgcgacttagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcaatcacccttaagtgggtgttcaagctgaagagggatgaagccggagccatcgtcaagcacaaggctcgcttggtagcacgcggtttcgtgcagcaggaggggatcgactacgacgatgccttcgctcccgtggcacggatggagtccgtgcgactcctttttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcattggaggaaatgccttgctggtgggtgtctacgtcgacgacttggtgatcaccggcaccaaggatgcggaggtcgcggcgttcaaggaggagatgaaggccactttccagatgagtgatctggggcctctctccttctacctggggatcgaagtgcaccaggacaactccgggatcacgcttcgacagaccgcctatgccaagcgcgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggtttatgcagcgaccgacgacggagcaccagcaggccgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggcggcatccgccgcttcgacccaggcgctctggcttgctcgactgcttagtgatctcctcggcagagatactggagcggtggagctcagggtggatagcaagtccgctctggccctggcaaagaaccccgtttttcacgaacggagcaagcacatccgggtgaggtaccatttcatccgaagctacttggaggaagggagcatcaaggcgagctacattaacaccaaggaccagcttgcggatttgctcaccaaaccccttgggaggatcaagttccttgagctttgctcccggatcgggatggctcaactttcccacaagacggcgcacaagacttagggggagaatgtaggaataagtcttggctggttggtcttggtcttgtggtgcctttttcctgcttttcagctttctaggacagcatctctttctaggacagcatctctactttcagtttgagatgctctaggacagtttgttgggatgctctgctctaggacagtttgttgggatgctctaggacagcaccctcttagactagcatggctgcatggctgctacaagcagctataaatatgtatccaatcctttttgggaggatatggcttttgtgtttagtgaatgaagaaaaccagaaaattgccccatctcgagtgccatcctcttctcaatgagagtaaccattgaaattctaacagttacactttgcagcaaaacctccaatccattacccttacacagatttagaaaggtggtattatcagggttgaagtagccttcggagtttgatgggcacataagaaagaataacagacatatcatatttgttgcctcctggtggctagagctggccagcacaaataaagaaaaatgtactggaaataaaaagggaaatgcaaaatagtaggaaaatgaaaaatattcaagttcataattctgtttaatcattatgcaattaagctcatcttaatcttattgaccatccatatttttatgaaatataaatgcacgggactagtttatcgtgtaattttgttaggaaatttgggtttgaatcagtggaaatgtctgaattagtgcaccactcaaggttatccttgtatcccctgtgctttagcggttattaacttgagtaagtggcaaatacattctttatgttttgctcccatattgctgatttcacttaatttgtcctctctgttctttgggcgattctatttattttctattaccgagtcaaaaagaaatcagtttgagaagcaatgtacgtcttctcctgctgcctgattattaaaaattggatttctaggatgtatttatgaacatcttgtgagactttgtaattttctgaatattttataggtttgggagctcacagcaaataacattattatggtatcagctattggaaatgatggccctctttatggcacgctaaataacccggctgatcagagtgacgtcattggtgttggtggtattgattacaataaccatatagcttcattttcctctcgaggcatgactacttgggagcttcctcatgggtacattgttcaacttaccagtacactattttcttagtctgtcactgactgttgtttttttccgatatctggatcctgtaggcttgaaaagctaaagctttgtatcatttcattagaacagagtgtacagtatataaaacctgtaagcctagttcagtggttttgtatatattatcttaaaaaaatttgatggagtttggagtacttacattcgacttatccttatatattatgttgataaaggtcattgctaggtttgtgcttaccaaacttggcactgcaagtgcacacaaaagatggtcatatgctaattctttttaatcacatactagcaggtcaagtagaattacgtcttactgatgttggtatcacataaagcttttttacaagaatttctcctgagaacttttgtaaatcatattcgataattttattgtagttgaaaatcagattgtttgtgatattaaatttatggcaagaaactatttcctgccccttgaactttaggcatttaattaatatctgtagtaaaaacttgaaatgatgaggcaattttttttggggggggggggggggggtagcgatgatcatttttttacaatgccatagtaccatcttctcttgtgctagcttcacagatccttgaattggcttactcataaggtgtggtttcaataatgcaggtatggccgtgttaaacctgatgttgttgcgtatagtcgtgatataatgggttcaaagatcagcacaggttgtaaaaccctttcaggcaccagtgttgcaagcccggtggttgctggtgtagtatgcttgcttgttagtgttataccagaggagcatcggaaatccatccttaaccctgcaacaatgaaacaagcccttgtagagggtgcttctaggctttcaggaccaaacatgtatgagcagggcgctggcaagattgacctgtaagtttcttgtcccttttaatgtactctttggtatgcctatgattagttggatattcaatacttcttgtatcccatcctttccaaacagcaaggtttgtccttcaaaatttagaggcagtatatcctgtcaagttggtttgcccttctttctattgtgtgctcaaacagatactcatttattgttttgtctttttccagctggcaatcatacgaaatcttgaaaagttaccaaccgcgtgcaagcatctttcctaatacccttgacttcactgattgtccctatttctggcctttttgccgccaacctctgtatgctggagctatgccagtggtcttcaatgctacaattctgaacgggatgggggtgattggttatgttaaggatcctcctgtatggcagccctctgaggatgtcggcaatattcttagtgttcacttcacctactcagatgtcatatggccttggacaggttatcttgccctgcacttacaagttaaagatgaaggatctcagttttcaggcataatcagtggcaaggtcacattgtcaatttacagcccagcagcccatggggaaagcagtccacgaagtagttcatgtgttctttacctgaaggtcaaggtggtgccaacacctgttaggtccagaagaatattgtgggaccaatttcataatatcaaatacccatctggttttgttccaagagattcacttaatgtgcataatgatatccttgactggcatggcgatcacttgcacacgaattttcatatactgttcaacatgctgagagatgcaggatactacattgagacccttggatctccacttacctgctttgatgctagcaattatgggacactgcttatggttgaccttgaggatgagtacttcagtgaggagattcagaaacttaaggatgatgttgtacacaaagggcttggcgttgttgtttttgcagagtggtatcatgtcgacacaatggttaagatgacattctttgatgaaaatacacgcagttggtggactccaattactgggggtgcaaatgttcctgcacttaatgaacttttggcaccatttggcattgcttttggggacaaagtactaagtggtgacttctcaatcaatggtgagcagacccactatgcttctgggactgatatagtgcaattcccagcaggaggttttttgcatagcttccaactccaggacaactctaaaatttctcaggataactcaagaagcgcagatacacaaaataccccagataaaagcaaggttagtatctattgcgcactatttcacattatttatctattttcttgaaatgcattctttcaaaatgatggtgtggccattacaatatttctacttgagcaagaacctaatgatgcactataggttgaatagttgtaatatgccatttgatggaggcatgcctggtcatttctcatgaaactgttccctagatttggtgcctttgtgtcagtgcctcctagtctgtggctctgtgcacatggtattatgattggtaggcaggttttttcaggaatatcaagttctgagctaaccaatggatggtggtcatgcttaacttgtaataatagtctcttgaactttcatgcaagattttgttggccatataagttgcaagtgttagattcttactaaaatcagttattccaaaacttaacttttatttatgagagcccatcaaaagctacgattaggcaaaatatgtaactttccaattgtgaagtttggacccttttatgaccagaattttctcatgtgccatactctgaactgttttttcttatggacatagatagtgatttaaattcagtaaaaggaggatactaatgagtgttctggccagttcattatgctggtagatactccctccgtcccaatatgtagcaacctaggatgggtctaatcccatcctaggttaacatattgggatggaggtgtaataatttgatatttgttttgatcgcaccattttatcatagcccttattttacagtatataatacttgctgtataggtatagtaaggcttatttgcttctccttggcagctctcttctattcttggaatgatggaagcaggcaaaggtcgggttgcagtctatggagattcaaattgccttgacagtagtcacatggtaacaaactgctattggcttttgagaaaacttgtggagttcactggcaatagaatcaaagatcctgttcttttctcagaatctgctcagttaaaatttccagtttttgagagcatccatcaactgtcacgtagaccagatgtgaacttctcaacatattcaactgtcgttggcaatgaattgatctgtcaccaggattcccgatttgaggtttggggaacgaaaggttatggtacccaacaaacaggcacaacaagaaagttgccagagtaccagaaaagtgaagcttacaacatttcaacaccaatagcttctgacagcacaccagatgaagctggcctgcaaagaaatatttcaacaccaatagcttctaagtttgataaaagaatggactattttggttttctcgggcacgaagaggtatcctgtcttgccttcctctttgtagtggctaacatttgttaagttagcatattgcacttgatcaagcaataactctagtttcttacattttctcagaattct

SEQ ID NO: 502 - DNA, 16450 bp, Oryza sativa
  misc_feature (1)..(16450): CLB6133.4 (OsMADS6)
  misc_feature (11959)..(11961): m is a or c
  misc_feature (11968)..(11968): r is a or g
  misc_feature (13320)..(13320): y is c or t
  misc_feature (16044)..(16044): k is g or t
  misc_feature (16447)..(16447): y is c or t
cgttacaagttcgtcactgctatctgtgtcccaatcccaaccgtccatctctatccatgtgctagtggctccatcaatgcaactaacggacgtgtcctctctcgtccacactaggactagccaatgtggtttacaaccgtcaagcgctgacttgttcttcgatcgtcttcatctcggatagcgcctgtcaactgtatgattgaacatggacatacggttgcgaattactccgtatagtacccttgagtctcgctctgaaccactagtgcctggtggactccgtcacgcagtgagcatcggggaaaaaaaaagcaaaacatgactccacttccgtgctgtactctggtgaggcgagaaaagtcgaaaaccgcatagcaagttgtacaagtgtattattagtaggagtaaacaacacaagcaacagtatggagtagaagcacctacgaattttccgtctgaccagcgagcccgtcatccgtctttgccgcgccggggaccccacgcccactcgccctcgcccaaatcaagtttcggcgtgcgtttcccatgtgcccccacgcccgtagtccgtgcgcacgtaccagggcggcgggggcaccaccccggtcaaactcaaacgaactcaaaacaacccgcgacgttgtcccgttacgcgtcagcttgccacgccacgcggttaaaacgtacggcaagcgcgcctctggttccttccgcacgccgcacgcgcgttatccaccaaaaaccacgtgaaaacgtctcggtatcgatcacctcaccacaccgcccgcgaggccgcgaccgccgaccggcgcccatcaccgctggcgctctatataagcgcgcgcgctcgtaacgactagtcgtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatcatggggttccctctggtgtgctactgcatggcgatcccaagccgctcatcgccttggccaagctcctcgccgccatcagggaggccctccagctgatgctcttcgtcgtcgggatctgccaccacccggagcgatcgggccgcccggctgccgtcgacgccccgctgcccgacgaggtgaaggaccgcctcccgcccctcgagttcgcccagctgctcgcggcctcggagcacggctgtcatggctgcgacgacgacgaggcggtggcggggtgcatcgtgtgcctggagaggctggaggcggatgacgtggtgcggcggctgggcaactgcgcgcacgcgttccaccgcggctgcatcgaccggtggatcgacctcggccggttgacgtgcccgctgtgccgctccaccctgctgccgcgcgcgcgccccgccgccggcccgcgcgggcgactgggccgcctcgccacccgcctcacgggcgtcgtttggtgaatcaatatttggcccgcgcgaccgcgacgcgacacgggatcggttgggtgggagggcagtcgcgccatttcacagcctaagctagcttactgctgctgttaatcaacggagacaaagctctctttccctttcgtttcctttttctttttctgccgaggattatccagctggaggagagtggtacgtgtcggaatgcggtggaatatatcgatgattagacggtaggaacaattaattagaagcaggcaagcagctggttggttggcccggcctggcacctggcatgatcattgggaggttcatgtaattactgcgatgattagatactgcatgtaagtaaatcatgtcatagagataatacacctgtgtacagtggtataatgataaacggttcatttggtatgtctctgtttttctggtccggtattgggtttttcaatgtttgcaaattgaacctttatggttatactagtacgtcactgaaccgagagctgaactggtccattttgcatatataatttattgatccacttgatcatgatgcatgattgtgtatcaactggaatgtctttatgattttgtaggactgggatcatttgtcctatacagaagctcctagctagtcgttgcaaaactaatgtgtggaatattccaaatttgcctctttatccttccacagttctaaatgtggaaggaacagggcatatatctatttcgagtcagctacactcatatttctgaactttcggtgtaaatttcgagtataacttttttaaattaagtgcgactcaattacttctctctgattttcaattgttgacgtgtggacccgctacataaggaacccggccatatatcagtaatgagtaatccacgttagagagaagctagatgatcttaatccctcctcgttcttagtactttgttatttaattattgactgtgttcgaagtaaacaaacaaacggcccaagataagctgactgaattgactggtcccgttcttttctttaataagagttggatgaaaaattaagattttcgtggcacgttttttaaactactaaacgatgtgttttgtgcgaaaattttctatatgaaagttgctctaaaatatcatattaatatatttttcaagttcgtaataattaaaactcaatcaatcatacgttaataccatctcgttttgcataaaaaacttaaccttaggtggtgttgaatctcctgaaaatgaagatgaagataaagattaagtgtttcacgcaaaatgaggtggtaataacgtgtgattaattgagttttaattattacaaacttaaaaaatggagtaatatgatattttagagcaactttcatatagaaagttttcgcacaaaacacatcgtttagtagtttaaaaagcgtgccacgagaatccaaaattttatcctacccttgcagaagaaacaaacggggcatcttcaggagaaaagaacacagccttgaaagcacattggcatcaaatttaacctttaaaaagcaaatagtctagcttacctgctaaggtcctttataatgaacctgtgtatcgagtttaagtatcacacttagtacatatggttgttcgtatttacggttaattgttctttaagttgttagcaatgtacttgtcaacaacgaggctcctacgataactttatcattcttatgatatacactcatagttagaagcacggtgtgcatgagtgttcataaggacaaatatataagtgtatacgagtgtttttgtatttgcgtctattatatgtttaaataaaatatcacctaaataaatatgaatatagtacgtatttaactagaccagcagtttgaattaaatctactactagtatgtacttgcgccattaactggattcttccaacgttcttctctcaccttgaacgaaagtacattcatcaatatcagcaacaccaatcattttcggccatgatcagatggccctgcgtgcctgttgagccaccttcccttgtgagataaaggctacagcttcagcaatctacagaaactgaaggaaaaaattctgtataatattgaatgcatatgtacgtaccaatcaattgatgagtgcacatgacatcctacttgattaattatggggttatggcaaattcgatcagattcctttattcaatagtacaattagtttgcacccataccgttacaaggaaaaaacgagatcatcttcatgcttctgattgtcatgtcattgtcattattcaataactaaacagtactagctggaatgaagttctggagataaacattgcatacatgttgtggtttcattgaaaaggggatgtcgatcaaaagtccaatatgttatatatgttatatatcgtcacaaattttcttgtaaccatgagttgttttggctatggttcacacgcactatatagtttgtatataaaaataaatattttacaaatttgtgtgctagattataaccgcgcctcacaatttcatgaatcgtcaaagtgattactctaaaaaaatattaatagaaaatccaagaattgaagtcacatattggatggtgatactaaatcagaaaaataaaacaaattagatgctgatcataccttcatgtgtgtcaagcatgtgaaagattgctacacaacgaggattagaaggctgatgccattgtgtaatgaatggaggagagctgtgacaaggtgacaaaagaggctagcaactgggtgagatcacaatggggctaacggttgtgaggattatggttggggaaggatggtagaggaatggtttcatatatatacaccacaaaaagattccaaacataaatcgttttcaacttttgcacaagaactaaaatagtaattaaattaatgtatgttacaatccattcatgagagtgatacaatgtattacctttgttttagattataatttgttttgactttggttaaagtcaaactattttaaattcgaccaaatttataaacaaatttagtaatacttgcaataccaaattaatttaattaaatctataattcaatatgtttttataatatatttgtcttgtgttgaatatgttactacttttatctacaaacttggttaaacttgaaacagtttaactttgactaaagttaaaacaacttataatctgaaatagagggagtacatatttagagtaattttacagttattgagtaagtactgggattttagtgtaaaattttgtacttctcgatacactacctcagtttcaggttataagactttcaagcattgtccacattcatatataaacggagaaagtactaaattttggtattaaaaaaatttgatacctcttgatacattttaagtgatgtaaaatttctcatgtatttaacaagggcaacaataagaaaaaactaaaaattgtcttaaatatcctagagtgacttgtatattatgaaagtttaccattcaacatttggtactggaggtaccataaattttgatatcccaaaatattttctagtataaaatttggtattggatggtaaaattggctcttatactaaagatgtgattttggaaagaaatcatccataacacatcatctaaaatgaaaccgttgtcgtcggtcacatatgctatatagagtacgtaataaacagtttacccaaagctggtaagattattttcaaacaagatccaaatcaaaacataaaaaggtagcacggaaacacaaccacggacgcagaaggtgcaaacagctagcagtagcttacacacaaaaacatacagattaaagggccacgcaagaccattaggtggctcgcagagagatccgagatacatgtagcccactccacatcccttttattattagctccaacttctgacagctgatcgatggctgcttagctcaaagaacccatcccagcatgaagttgttctctgcacctgcaggggcagtgctcctctgaatagtgtttgcttcagcaggcacaaattgatgaggatacctagtaacataatcgtttttcagataatataatggaagcaagatatacacagtcagtttgatgagaatctttcattagttctactagttcggatgctgtgatcgagctgtatgcatttgagctagaagttataagtatatgcatttctggtcttggcttttcttgattaatcttacccaatttgcaaggtgggttcagagtccatggccgcggagtgtggcggcggctgcacgtatgcggcgccattctccaccacggcgccctgagcccaggaggcttgctgcatggctctgtagttgctggtggaaccttcaacctcgagctgcagcattggatatgagaatatatgaatgaaaattatcaataaataattatatgtgcaccgcattggcataacagatttccgagtgaataagaaccttgtgcttgagttgcctattaatttcacccagctgacgctcctgtggcacaagaaaaatatattggagatagtataatatgtaacaactctcatgaaagaaatctctcgcaagaacgaagctaccatttctttagttatacagtcaaaggctacacgatctaccctaattaacttgcatgcggtataccctagcagccttgctggcaatatagatgcattgtcaaagctagccaagtcatttcgtggtttaatttagattatcactagtagctagcactcctgaagtcacccgcccatggcaatgctgatactgtatgtatgcttgagaaactttggattgataatgtacctttctgcgaagttcctccacttgttccatcatcagttgcgtctgcacaaaaaccattcaagcacagtcatattgagttgacagtaatataatgaagtgtagattatatccagtttctgaactttcatgtgttctacctagctatttcttgggatcttttatggtccttgggagattttgaagcatgtacgacgcaccacaaaatgaatactagtgtatatttaatctctctacctctatccttcaaagttctattttctttgggttattcacttattctttttttagcagctaaattttcctgaaactccagaattgaagccatattatttcatcagctactcattgtcattactatccttgttgacgggattgtcatgcagctttgaagtgttttattttgaaaagagtaaacatataattattaattagcctaaacaagcagccataagtagtagtatatctgaaattgacagtttagattaatgttgcagttgctcggccctgtcactacacatgtatccatataaagaaaaagggcatgcgtgctagccattctatatttctattctatacttagatagtcttttatatgaaatttagtgccactgtatgcatcaccttcgtgcctagaatagggtgaatttatcaagatacatgctacgcccagttgcttcaaattacttgtcattctacgtttgtcctaattcaaacacttatatatatttttgaccattagtttctaaaaaaatgatactatagtttaacaccacaagggttatgttgttagatacacaacatgaaaaatccttacagaatgtacagttcacattttgttaaactacacaaatttccagaaattgatggttaaagataatgacttagggcaaatttatgaaacaaagggattacttatgctgcatagtagctttcacacttctttaaaaatatcatcagttgacctttaccataaaataaggtatcaatattctaagtgaaatatgtcttggctttctaccaaaccaccaccatgcattagctagagattgaaacaattttagcaattctctttagataatgtaggataagcattcccagttattatgttcacttccatgaacaaaaacaaattagttaggtgctctttatataaactttagcaaggggatattccatagctagcgtacacctcctgtctatttataaatatatataactttacctacaaactaaagacatactgtatattttattgcttctcacgtattgcacctatatccaaatcagtggacaaataacaagcgaaccagggtaggctagaaacagaagtattttggttccaaacaaaggactgcagaatgccataaacctttctctgtctcgcctgtgatagtgcacattcaagctgtttctccagctgctgcaattctttgacgctgagtggtccaagatcctccccaagcaagtgcctttaagaatcaagcaaaacccaaagagcataatgtaaatattaaggtaaattgcatgacacataaagtttcgcagcagctatattacagaataatgtgtgtaaatgcacgttatgggctgcttcttccctctttcccttaacacaacattatcacttgcatgcatgttatagaaaaatatattgtgtatttgcaggagttatgcttcttggagagatcatagtgaaatacctttgagtgcgctgcaaagcttcaaattttgctttcaactttgacatttcatggtaccaactcttcaggatcagaggaaaagaaaaaccattagttcagttcacaaaaatatttatcagctagttctaacgactaaggaactgtgtgtttggcgaatcatacactgaatattagtgttacacagagcaaattaactttctgcggtttctttaaacacttgataaaagtcgtttgtgaattttaactaaatatgtcacatggcctccttgtacatatacgttgggcttattctttttttaaaattttgtgaaacatgctattaatgatacagctagcaaactatatatactgattattgggcaaataagttgcaggatgtcaatgatataaatataaccaagtgacataactccttagatattttgcggttggtaagttctcaagaatttcaatttgatctcatgacttttgaaattatgcacaagggcatctatgtttttgtttgaaatgttatgaggacgtactctaattgattgactgaaatttagaatcaccataaagagtactccctccgtcccacgaaaaaccaacctaggctgtgtttagttccacgccaaaattggaagtttgaagatattggaacgatgtgacggaaaagttggaagtttgtatgtaggaaagttcgatgtgacggaaaagttaaaagtttgaaaaaaaaattggaatctaaacagggccctagtactggatgtgacatatcctagtccaatgaatctggacgtaccctgactgagggagtactatctggtcacagaggtacacccttatttttttgggatgtgcactattgttgtacattcaatcaccatctatatttaaatattgaactacatcgactaatttacttcatactggtggctgtattttagcctagctaggagtatatttgtatattcgtcgatgcagggaatatatacttcatattcgatgcagggaatacttcatgtaaggttacactagggagctaggggcacaaaaagtcatttagactagctatttgtatattctatgctggtaaaaacctatactaggtgcaacatttctgaatacatatacgccgtaaacagcacgatcttgcattgtaatatggtataattataacaaacaactagtttgataccccgcgcgttgctacgggattttatggtgatgataaacaactttgtaaatatgtgcttacaaacagaattgaagaattgaaatatcaaaagtaaacattctaaaataataaagtgtaaagttggcatttgagtggtagatggttaagggatatagcagtggcttaatatgggggatgcatgtaatgcatgaccaggagcacttaagtgggtcatccattgatgtgcctaattacccatggcagtttccttacttaaggcatgcacagttaaacaaacaaagatgcatttgatccgacggctattgattatcgatgatgtggcttaacctggatgcttctttatagtgttaatgcttgtagtgggtaccaactatataggaagaagggattgtctttgttgtcctcctttgacatgtcaataaaaacttcatttattacataaaatatggttaatgcatgccggtgttgaaattctactagtttaattcttctaaactttgccattctttagaatgcttttacgaaaagaacatccgatttagtagctgtgtcaagtaaaatattttaagtcactgcaaattagctttgggatacatcatcaaattaacacagttatgctaatctgtgtactttttattgaatgtaatctcacaatacgatgaaaatacctagctaggtttatactgtagctaatttcaatgtcaggacattgataattgcatattcatacaaaaatatatatagtaaaaaaacaagacccattttgaaaccaaaaccaacagcagaaattcatgaccagttcatgcagatatatatacctgggtttcagaaagtgcattgttggaatcttgagcattgtagcaacaatgttggtacctttctaaagtctttgttatgctgcacaaaaatgttatatgtaaatttctcatatatcaaattactacgacgtaaaaagtgcatagatgttatttatagaggcagaagcttatattataatgatatcaaaggtcactctatatttactatttcttttcgtccaacaaaatgatcatgttttttttggcaaaacatagtatgtaagaacgtaaaaaaaaaacatagaaatgttacttgtagagccagaagcttatattataactcttgatttatgacatagataatttttttcatccaacaaactgatcacatgtgttttgataaaacatgcagtcagctttcatcgttgaagtggctttgtgtgagatatcacgaagtgactttgtgttgcatttatagattgataaaattattggttacaataactaggttttactacctccgccctaaattagtggttgctttaactttttcttgtaacatttgaccattcatcttatttgaaaaattagtgcacttataaaaaaagataagtcatatttgaaatacttttgataataaagtaaatcacaaacaaaataaataataatacgataatttttttaaataagataaataaccaaacgttaaaagaataactgaaagcgacaagtatttaaaagtgatcgatgtgtagagacacacacaaatctaggcgaatgctttgtaaaccataaacaagaagcttgtgaacaacacaattaatggtccaaggcataaactgattagtggtgtgaagaaggaaaagatggtccgaggtataaacaataattgattagtgtcccaattgcttcaagaagtatagacccttgactattcagggaaaaaaaagactttcctgacggtcaaaacacaggcgcgccgactccaattcaaaacgaacacatgcatgattttacagaaggaaatcaaggtctgtttcttatacaaatacatgttagatcgtctggttagttgaagtgataacaacagctttttcatgcatgaaaagatcatctcaaatgcctggtgaatataggctttatcttataatggtcaaaacagattgaaacatattaaatatatactcgaaaaagaatagactgaaaaatatcaaatctttttcaatgaaacagttggatgcatacatagttaaattcaggcgcgcgcgcgcgcacatatatatatatatgcatatagcatctaattaacccttcagttgattttccctattgtatgattttcacaatcaaagatgtggattggatcttgaaaagttataatgttatccacataaactctatacttagcgggaaatatgccaaaaacaaaacaaaagagctagattttacatataaacatgtgagtgcagattataaaaaatcccccttatcaaggaaaaaatgtcatcacgaataaatagagaaattaccctgttaagctcccttttttcataataagtaaaacttttcgtgcaccattttagatctgtcacaaacgtacccaccaactaggcaaataatgaaaagatctccaagttgagctagtacgaaacaactaggagtcaagcaacatccatgattagtaaagaataaagaatggtttaagccgtagtaggaatcgtcatgaaatgaggagaaagaagagcaaagatcaaatatagacaattttggccacaccaccacaagcgaaacagatgcaggcctgacatcaagtgttgatatatagaaaatccattcaacatatttccggttgaacttacatacagtcaaattgagaatgcatcatgctataactgacagatcaaaatgatcaagccaagatgaggaagaagatagamcmagagaarggggggggggaaataaggtgatggcatcagaactcaaagtatgaagacctcccgagcaaaaatagatctaattaaatttcttccagtatatatggaagtagaaaacacgaattaaatttgattcatgctgagaaacatggcatgagatccgaaggaagtggaaagctaggagaagggtgatgaagaacaatgaaattgatcagttcatagcatggggaggtgagggtaagaccaaaatggagcggtgctacgctgctacgccgattcttccagggtcatcacaaagtatgaaaatcaatgtgccggaaagatcttaataccagaaggggctcccctgatggatcaaaaaggaaagaacataccttcctttctagtttgcagccttcatgctaactctccactcagttctcacacacaacacaccctctctagtactggttttgagaaatttatcgttcgagctgtctctgacacacgcacaacccggaagatgggcaataataatccaaggaagacccggagaaactggaagaaagaggtcagcaggagtagggtttgtatagatccgctgaaaagatatcctcccatgctagttagggatccggcctcccggtttataagaacaccgcgccatgtccctatagtagtatgcacagacacacacagacagacggaataaaataattaacatggccaggtaagtatagtagctcggctacttggcacctgctaaaaataaatgaaaaagaaaacgagaaaccccagaggagcaggacgccgttgcagcagataaaagaaacaaaaaagaacaaaaaaaaagaagcaattgatcagagaaaacagcagatctgcaggttcaaattgatgctggtttgttggttgtgtgtgttgttgtgtctgtattaattatacccggcgctgccgaactcgtagagcttgccgcggctggagaagatgatgagcgcgacctcggcgtcgcagagaacggacagctcgtaggccttcttgaggaggccgttgcggcgcttggagaaggtgacctgcctgttgatcttgttctcgatgcgcttcagctcaactcttcccctccccatctcgcccgatcgatcgaacgattcctcagctcagcaccgatcagcaagcacaggctagctagctcctcctccaccaccaccaccactgcctctcttcttgcttgctaaagcctccaatgatgacgagaatataacgagccgcgcgagaagaggagaatattagtggagtcgagtccggagaaaggacattgggcactgtaccacagtagtacactagtactagtagtagctctttgtgaaactggtttcttgcttgctttgacacacatctctctttctatctctctctctctccctccatcacaattcacacacctyctctccctttcaacaataaagaagggtaactttggcgtggggctagcaagtttaccacaggttttaccctaactgggaagcacgagccaaaatgggggcaatccaatgccacacccgccacaccacaaatatacaccgttgcgatgatgcatatatgcatatacacgaggaagatggccaaaggaggggagagggctactcccagactcacagtctctctctcttgcgcgcgcacacacactgctctcctagacttaacccaaaccatgtatgtcgccacctactggtccaatggaccacggcaccgtccggtagaggctgcccaaaaataaagaagcagggaggggaggcttaaggattgttttgccagcatctgtgctttatccaataatccagtttgcctttgggtgcatatgcatggtagagctaggtagtagtagtacttgtattattctcctctccccatatctttgacaaattccagttgccgggcatactgctcatgcatgattaatgtttttcctttccctttttttctctttttgtttttttgcgtagctaggctcgatctactgcacggttccaacatatattgctgcaggtacttcttgtgacttgtttagtaaaaagaattgcgtaaatatcatttgtttcattgtaactaattttatcattgaaggtatatatatttgcgcaaactatctaaataagatacatggttaaatatatgaccaaaagtcaataggatcgtatatttaaaaacagaagtagtaataaagaaggctaactttgcacgacaaagaaaattgcaaaatgatccccatttatagaaaaatccattgagcttgtgctctcaagcttactaataatgtaatcaacaaaacctgtgaattaattaagtcatgcaatagattggcactggtagatatttcaagagtaatattcagcaagggaccacatgcatatgatgcacagaattgaaatgacatctcaatgtacttgtgcatcagcaagggaccatatgatgtttgccctagctagttcacaaatcctgtgtctattcccggtcgtttctttattttttttatttgatgcattttaagtgggaaattcattttaatattttttcctcatgttttcttcgtgttcccacatcacaccatcgtcctagaaaccgtcccaacctttgacatcctttaagccacccactggtcatggtggaggcaattaacaggaggccagacatcctctgccggccaatggccaccttctttcaatctccaccagttggataagagttcgcaccacctctagcagcaatggtcgtccgaggtcgtcaacacatcattgcaggggagccgttggcttcctcaagtagccccatgagcacactgtcactatgatccactgtgccagatcctaccggcagagacgagaatgcgatcagggtggtggtcaagctaggaggataagtcggtagacacggggatatgggtagcgtggtaccaacaatggagcgtggtatgcgtatgctaccgtgctcatcacttgggggacgacaccgccccgatgaactggataccccaggtgcatttctgtcttttcatttgcacatgtgccttctgcgccctcatccattcaaaaaaatataaaataatggggagggcgatctctaccatgaaatcaattactacatctcaaagtctccctccaaaagttaaatatattgtgaggtgctaactaaaattaaccacacaatgatgatgtactttagcaaaatttgctagaaagaacggtatagctcttggcaacaaggatcattaaatctctcataaaaataatattcattttctttccgttaatttcttttttatcatctctctccagacaattcattttttttacaacagcaccggagagaaagtttaaatgaattacactgcaaatgatatccaaattaactatccatatcgtctataatcagttaactgaaacaacatatgatgatttgttagcatgcccattatatataagactttgcaatgtcacgactagataaaccatggaaaatccacaacttaaaacattctaacttgtagttagaacatttattaacattacccgagctaccatcatgttagatagaatcctttatataccactgaaaatcagtctgatcccttatataccactgaaaattggttcatcccctatatgccattggtccaaaattgcgcaccctatcatgcaacttccatcagttgactgtgttgaccgttaactctaaagtaaaaaagacacatttgcccttcttgagttgttaggcatgtcctatactcagaaaggcaaatacgtcttttttacttgagagttaacagtcaacccacagacaacagacgagagtggcataagagagtgcgcaaatttggtccaatgacatataaggacatagccaattttcagtggcatataagagattctctcgtcatgttacagtgtgcaccaacaagattgaacttgtcaagttaaaattatttttaactagtgttttaaaacatttttaagaaaacttttatacgtgtacattctccctagcaaaagaacttgtgaccgagatttttcattaaaattttattctgattgttagcgtagtgatggggatgtatatatggtttaaccctgtggacctatgttcgatttttgacatgcccacactttattttkgattatttgagatgcactttcaagtgtgtagttgtaggtgtgtatggttttaacccagatgtaggtcccgctcaattctcaacaagttcactctccgtccttaattattcttgtccgggtagcttttttttataatggcgaggtacattaattcaaaaaatgcaaaccactattatattacttgtgtacaatgataggcttttcgcaagactctactttattggactatagctcatatggtactcatcaactcaggttttcagtgatttacaagttgtatgcaggtctttttcattctttgttgtagaacatgcatgtgatcgaacaggctctttcagagaggagagagagagagagagagggagagaggggggggggggaaacctgccctaaaatgcccttycct

SEQ ID NO: 503 - DNA, 9400 bp, Oryza sativa
  misc_feature (1)..(9400): CL002227.118 (OsMADS8)
  misc_feature (1)..(9400): n is a, c, g, or t
  misc_feature (14)..(15): n is a, c, g, or t
  misc_feature (10)..(10): m is a or c
  misc_feature (3500)..(3500): y is c or t
  misc_feature (6440)..(3440): k is g or t
  misc_feature (6534)..(6534): k is g or t
cccccccccmaaannaaaaaatcatatataccctaaaaaaaattgcccctcaaaaaactaaaaattgaggaaaaaaacagatcccaagggaattcgaaactcgcataccctccattaggagatcgataaaattaagattcgaagcttccaacgattaattttctccgtaaaaatcgacttgctgatccaggcttaaatcctgaatgtcccatcccatgcatgcacataaattaatcgcaattaaaccaaactcaaaaccattaagcgcgccatctcaaaaccactactaccacgggatcagaaaccctcagatctacgtatttcaccactccctattacgctagctagcacccgatcgaacgaacaaaaaccctaattattcccacagaattccaccaacttccttctcccaaaccctcccaaaactcaccaaaacacgagcacactcgcagatccaccatgtgcagccccagatccccgcaaaatcgccaccaagaagttcacaaaaccatcgtgcgctccagatctggaggcgcaggcgcgcgcaagaaaccctagctagctacgttgcaagcagctaccgatctagctatagcagatcgaggcgcgcgcccagtgcgtccatgtatatatacctttggccgctgcagaactcgtagagcttgccgcggttggagaagatgatgagggcgacctcggcgtcgcagagcacggagagctcgtacgccttcttgagcagcccattcctccgcttcgcgaacgtcacctgcctgttgatcttgttctcgatcctcttcagctccaccctccctctccccatcccgatctcctcctcctcctcctcctccacctcacctcaccgccgctcgagctcgatcaatcgcgagatgaatcaaccaatctcgcgaagcgaaagagaggggaaagctaaggcgaggaggaggaggaggagggggaaggggatgaggggtttaaaaagggaaagggggagagggtgggcagcggcggtgggggctacccggcattgccatttccggcaaggtggtggaacgacgcggaaccctaggcggcctcgatcgatccatcgtacgcaaaggcaaagctatctaggttaatttcgcactaatctccgacccaattcaatgcgtctctcactgattgctttggattttctctctctctctctctctctctctctctcctcgtcgacgcagcggtggcgactgaggattcgacaggtcgagaaattaagcgcggaaaagctggggaaaagtgagtagagttgggcgcttttgcacttgaaacctcggagttttcgggtttcgggaaaaatacccttcttgtgtccactaggagccggtgggtgatctgttgggagagcttaaggctttgtttagtttccaaaataaacaattttcacccatcacatcgaatatttaaatacatgcatggagtattaaatgtggaaaaaaaaccagttacacaatttgcgtgtaaattacgagacgaatcttttaagtctaattgcgcctgatttgacaatgtggtgctgcagtaaacatttgctaatgacggattaattgagctcaataaatttgtcttgcagttttttgacggaatctgtaatttgttttgttattgtaccacatttaatactaatgtgtgtccgtatatccaatgtgacaaacaaacccaaaaattttccccaactaaataaggcctaagattttgggaaatagctagttagtatcaagcttctgagaatatggagaatgtggatttctcagcttctgttttctagttaattttttagattctataattagagcttttgagaatttggatgaaaaactagactatgtagagaggattaatatgattttgagagaagatacagcggtcagaaaatccccatacagacccttacaacttttctcttgggttgcagttgcaaatcaaagcagcaaaatgaaccaaggtagcatagtatatatctagctagctagcgatgtggttgccaagttgccatagttcgtgtagacaaaatggagctgtttgggtttggatagagagaggcttcttcgatcggtatatctctttgcctgcagagaactttgccgttgcagtgcttgcagtagtagatatatatgtgtgtgtaaggtttgaagtcttggctaggcaggagtgtatgttctttcattttacctaattggtcgtgattctgaagagatcgatatatattctacctgggatatataggaactgatcaaaggattaatcattaatggtgtatgtaactttggtgtggtaacgtatcacagatgttaagtgcaaactagctagctagagatggacaaattaggctgcaggctaactaattttggttaagttaattagtatccatgcatgctgggaactcaaattagcaagagggggagatatatgaaaagcaaaataactagtatatgttataaaattaatgatgtattcatgttgtggttaatttaattaggggttgactgttggcacggggtgtccagtttataaaaagaaaagttaacatatgaatttgacatgtgctatgtatatgtgaaatgtcaatgaattaaaccgtccctgtaaactttttaaattgtggcttattcagcattataattttttttacctttttttctagtccaacatttcaaaggctgaccaagtttataaaaaaaacatactaacatttttaagataaaacaaacgtagtatctaaatatattcaatgttagattaaatgaaactaatttgatattttagatgttgctaattttttttataaacttgaaaaaaaaagtcaaatcaacttataatatgaaatgtagggagtagcgtgcaaagattacattaattttgaagtgcattgcaaattttgtgcttgtggatatatccggttcaatttatcaatacaataaagttgaatgttcaatatgtagtatcatttgcactttaaagcttagattaataagtatataatggtgcatgctaggtatatctatattatacatgcatgtttttcctcttaattacaactaatccgtacgtatacgcatgcagaaataaccccaacaaaattatgtacgatacagtagccaacccaatgtgttatataccacaattaacacggttcgtttgaaaactacaagctcaggtcagcttaggcatgccaggatttggcatttcgcaaaaaatggttggtcatcggtttgtgaaaaccgatcaatattagttggttttcgtacggtgttaaccaaaattcatcagtatttaacggttctcaatggatcggtttgcagtaaacgagtggaaggtggttctttatttcaaaaaaaaaaaggtaattaaacatgggtatgcaagactatcacatacggaataatagctcagcaaattgagccgttcttttcttcaaattcctcaatttcattagcacttttttcaaactatttaatggtgtgttyttttttaaaaaaattaaaaattctatatagatgttgtttgaaaaatcatttttaagtttataattattaatattaattaattatatgctaatgaaatttctcgtttcaagtgagcagaaaatttctctccaacttgaggatataagggcatccgcaatggttatctataggctctatacaagagatccatgtcatcatatttttctaattggaagaggttaaatgaagagaaagagagagagtaaagctttctactaacatggagatagtctatagagaaaaacgatgtaatggatgagagatctatagatacccatgtagacataatattgaggtggtttactattaatctagtctattactgagatgtacatgttttgttttatagaaagcaacttactttaccattgcgggtgttaaaaagctacaccacccacacccatcccccgcacgcaacaacatggttggtgcgcttgactagaccctgaagcccccgtcatcgcgtcgtcggcaggcacacctgcgagcccaacggtccggaccgggtgctcacgagatatctgcaggcaattttaatctgggctatatatatatatatatcgtcccatctcgcgcgcgacttgatcgatcggtgatcgcgaccggccggcgtgacggagtacgtacgacggacggacacgtaccgggtcgatcgatcggatgccatcatgccgcgatcgtcgatacgtaccgggcccatggtattcgtccgttcgatgtatcgtcgtacccaatgccatggacgcgcgacgaacgatcccggccgccggctgatccatggatggatcgatcgacgtgaggacgcggacccagagcagggagagagccgtgtgtgcgtgaaaaaatcccggtagattttggacggcaaaagccacgaaatggcttggctagcttgctagtactactccctccgtctcataatgatttatcctagaattacgaatctggacatatatagttcccatatagtccatatattaggttacaacgttatggaacggagggagtagtaggcagcttgaatgcttgatctatcggcgcgtcccgtccggcccggtgcctgcccacaaactactcgcgcttgcttgttgctgccttgcaatcaatccatcaatcaaacgtctcaacgatcaatcagttcaatcagtattatgtgtgtgtatgcgacgcagcgaccgtgtcgtgttgtgcttgtgcagttgtgcgccatttccattggcgtcatgtgactcatgtcacatgggcccaagacgacgacctaacgtgggctgcagatgggccgagttaattaccactggccgagaaaaagcccagacggaacagagctcctcctcctgctgcagtgctgccagtgaagtttctgtacaggaatttccatggaattctctgccgctatactcttttaatgaattaaatttgaaaatatagtgttcattcaattattttttgttagaaatatttaggatacagcacaaatataccatcggtctcgtacaaccattgtgcgaaaatgacgcataaatgatttcacgaccggtatcgtgcagtgaaagtgcgagaccgtgcggtctcgctcaagcaaacaacgataccgctcaaacaatcaacgctatcgctcaagcaaagagagatatcgtgccttgcctatttaattagcggttaattatactgattattaattaatcactaatcatgataattaatcactaattattattagttaattgttaattaagtacttgatcactaatcaaatggatcccattggacaatgtcacagatggcttctgcagtctcactcttccattccgcgagagaccgtgcggtctcgcgctttcgccgcgcgataccatccgtgatgttattcccgcgtcattttcgcgcaacggaagtgcgacaccgatgatatatttctgcataattttttgcatcccaaatattccttagaaaaaattgaatgaacggtacattttcaaatttaatttctcttttaatcaccggtgaatgtccacccgtttattgcatgtcatctaaattattattatttttttaaaaaataattgacaagatatgtaatatatcactacacaaacatgtaaattaaaatttaatttctacaaattgtaacataaacaacaaataaaactcaaagtagtgtatatatatttgcagttaaatttctcaattttgttacagcttgtaaaagttaaatttaatattacatgtttgtatagtgatatattacatattaatctatctagttaattttttaaaaataaatttataactatttagttgatatagttgatatgcaactaatggatggacgttcacccgatgattagaatcaatctccattctctgccaatttctgtgaaactttgctgctgctcagagaggtaaggtaactaaaacggaagcaccacaagaagagatcgaataacactgcacatcacaggtagtagtagtagttactaattacgggaggaacagctactgatactcttaactcttaatgataattactggggaaggctactaattaagctactgccacgagaatgggagcgacggcgacgtgccgtcggaggagccctcgccgccgacgtgaaacatgccgtggtagttcatctcgttctcgttggagcccggcaccagcacggcgttcagctgctgctgctgctgctgctcgctgtccatgctcgggcaggcgaacccgccgccggcgacggccgcggcggcgggcaactggcgaaccacggcgagctgccgccgaactgctgctgcaggttggggaccaacggctgcgccatggggatttggtggtggtggtggtgctcggctcccgccgccgccgccggtgacggctggaccatccggctgacgtcgacgctggaggakttggcccggggatgacagaagagagagagcacaatcggagtcgagcacttggtggtggtggtggtggtggttgggcggtggtcgtcgtcgttcktcgccgtcgtcagcccgtcggaggagaacatcttgttgctgctgctgctctccggtggcggcggcgcgacgacggtggtctggcacaccgagatctccagcgtcgccgccgccgccgcgccaccgccgccgccgaagcttatctgatcgccctcatggaggaacgggaaccgccggccttccttgggggagaacgccgccgtcgtcgccgacgacggcgagccgacgaaatgcggctgccggctggtcatcaccggatgagggtggtgatgatggctgtaatatggggtctcctcggatttgatgatcccaggccagcttggctctggtcttggaggagtgaaggacgcgaaccttgtccctacatttgaatacagaactaaaatggccgtcattaaaacaaatccgacgaaatgaaatctccattatgtaaaataaataaatgaatgaatgaaacaagccctagaacagctactaaattgttcggtgtggaagaagaaattcagtccgttgatttaactttaaagctccagttaatgtgggtatctggaatttcatctcagattccaattcttgaattaagtttgagtgattaactcaccatgcccactaaacacaataacccattcatatatgataataataataataaatctgacaatagtatcagaaaggtaaatatcaattgaaacataatactatgcacaacaagatataattttttttgctgttttaactgaaaacataagggttgcattgtgctctctaagctccatgtaatatataggcaaacctatcatcgatttacacaggaggaaactagtagaacttgcggaatacgtaagtatcaggtagattactgaacctcggttctacatgctacattttatgagcaattggggtataatttgcagtggcatattggtggagtctagatatacattactttttgtttgctttacagctcagatttctggtttaagcaagagaggacattacataatttattttcaactatgtcattagcattcaacatactcttcaaaacaacagtttttaaacaagaataccttgttgacttgtcataaagctgccagaactcatgctatctgcctgtggcttcctgcggcgtcgattgtgcccatccaagcgttttctacaactacgcttagcctcatcaaactccccaagcaagtgaaacctacagaaatgaaaagctatgatgagaattccaaacatcaaaatccttttttagtacttaataaatctttataaaacaaagcttgattgttatactaggaagtgaaagggaaaataaaatagagctgctttaatgctgaaaaggtagtgtgagttctaattgaagcaaaaacatattcagatgtacttgttttatctcagagataaataatacagtacatacgaatacttcaaaattaatggggctcagatgctatttaaaagaagaggaatgatacgtgtatttatttgctgaatattcaataatagcacccagcttcaattaaataaaatggtacacggctggaccaatcgtatttcaatgtgtcagctaataatttcaatgcatggggattcagttatataaaagttttgtactggcctgtcaagcacaagagaaaaaaaaacagtacaactttggcctctgggacatttggaccacggtataatggttccagcaggtatatggcagtatgcatcccaccagcctgttgcttcatgaggatcaccttttttttttgcaatgagcactgaggaatacttgataaagactggcaagcaatatggcattttaattttgctccactgggcatctgggagagggcaattaatcgttgcaaaggagtccccacaggatataaatttttcaggaggtggcgaatgattggctgataatatttgtactgtgttaaaggtaacatgatgcagaggtaatttgctcattatagctcaacaacgtaaaaggacatcacaaaaagtccacaactgaactagagatgaacctaatacaagatctcggcttgcgtagtatttttataaaataaaaaattgacaaattggaggcgcgcattagctccagagagtaggattcatatcggcagaaagtggaccacattatactcagttggtaagagtaagcattatgcttggaactaatttagaaaagcagctacagtagttgttatgtcctgaaggaaaaggattttcctttttttttttgtttgtggaagcaaatgattcagctggaaaaggacgaccatgctttaacaactgttttatttcagttcagtagtcaaataacaaggatgatgttcatattcctggaacaagatatactcttgaaaattaaatatagcttttactgtacagccaaatcggtcaaaatttcactgatatcttacccaaaaaatactgatcgaatttgaaaaggtgcacacaaaccaaccccaaaacacacaaaaaggggtaaggcaacctattgggtgtatttatctgatttgtaattagttaaccattgagtagacattggtatttgtaagggttatctggttgaatgcactatacagactgtagttagctttcaaacagcaaccttgttggtcccaacaacttaaataaagagcatagctaataacctgaagcaaagcaagccataatataaagcaggttgcatgttcaatatcatctttacaaatcaacagtccctcataataaatactgttgcacaaggatccacggaaaaaagtgaaataacttgtatggatctggtcactgattcagaaaggaaagatctaagcagaaaagggagctaggcaaacatgtcagaaatgggcctaatcaacccaggt

SEQ ID NO: 504 - DNA, 55786 bp, Oryza sativa
  misc_feature (1)..(55786): CLB17240.2 (OsMADS8)
  misc_feature (1)..(55786): k is g or t
  misc_feature (1)..(55786): m is a or c
  misc_feature (1)..(55786): r is a or g
  misc_feature (1)..(55786): s is c or t
  misc_feature (1)..(55786): v is a, c, or g
  misc_feature (1)..(55786): w is a or t
  misc_feature (1)..(55786): y is c or t
gagaaaataatctctttgttttttaataaatggtgctgatgacttctgaatatatgatcattcgttttattcaaaatttttatataaatgtataagatataaaacatgtttaaaatattttaagtgataaaataactaacaacaaaataaatttcaattaaataataataataataataataataataataataataataataataataataagacgacgaatggttaattgtgtaaccaagttaacgacatcatctattaaaaaacggaggtagtataccagtaccgctcgtgtataggtggtggccggtggtggctaaacaaccaacaatgaccatgatttaacgaaacaaggttgtgacttgtcccattgaggtgaagttgtaaccatacaccgatacacattcgcatgcctacttacaagagaaagtatataagtttaagagttaaacacaatggtcagatgaaagtttattacacatacatcttatcagatccaaaaattgaggtatatgtgccataacatatttattagtatcatgacttattaattatatttaaaccatagtattatcctctacgttttgctaaaagctatcggaatcgtcttacccgatcagcctagatccaccttgagcccttgatgcttatggttgtcttcaaatgtataaatttgttcctcaattagcactcatggtttgactgctagatataaggcgtatttgaaagaaatggattatagagtttaatttaattagcttagtcccttaacgatgttttggaaaagaaaaaagcaatgctagtgcgtaactgccatgacgtttttttccccatttacaataatactacataccttgacatttggcattggattaaataatcgttccaatagtctacatctatcaaatattcctcctttagttccacttgatctttcttaatttctacgtattttttcctaatcctatgagcctgtttagttggtgaaatgaaaatttttggatgttacatcggatgtttgaccggatgtcggaagggattttcggacacgaatgaaaaaaactaatttcataactcgcctgaaaaccgcgagacgaatcttttgagcctaattaagccgtcattagcacacgtgggctactgtagcacttaatggctaatcattgactaattaggctcaaaagattcgtctcgcgatttacatgcaaaatgtgtaattagtttttctttttatatatatttaatgcttcatacatgtgtacaaagattcgatgtgatgtttttacgaaaagttttggggaactaaacagggccaatgtagaggatttcgttttacattacccatattcataaactagaaatttccctggttagattttagagggggtttttttaagagaagggtatccactcttttagttccacttgatatttcttaacgatctcgctttacattacccctattcataaactagaaatttcctaggttagacttttgagttttttttaagagaatggtatccaaccggatgtatgcagcctttttaaattgaaaacatagtcctcaaataactcaatctgaaattcgatcacattgagatttgaatttaggatattgaagtgctactaaggttactgcaaccactaagctacatatcctttcgcaggctttagaggtatctagctgattttgtttctcattatgcatttgtgcggttatttaaaaaagagaatataagttagagtgaaacacactaatgggatgaacaatgaatggtcctttaatcactattgcaacaaaaagtttaattagttgatattgctactttgcctaatgcatatcattgtgccgacttgccccatgagacctaagtatgctctaccatgtcaaactcgaccatcccatatggccattatttggaagtggcaacaagggttgaattgcatagaagcattcttcgaatgtgtaaacttatgttgaaaaaggctaaatattggtttcttattagcacccacaatttgactggtagatattaatgtatatatgtttgaaagaaatggattattggttgaatttagctcagttcctcttgagattttgggaagaaattaaagaaacgaaatctagctgtaactagcatgatagttttatttccatttagagtatttacctggacttctggcattggattgaatggacatcctaatggtcttacatctcgctagtgtaaacttaaaatattcaaagggaaataaccaagaaagaaattaaagccgcctcttttagttccacttgatcttccttactaattttttagtattttttagaaagctcatgtagaagatcatattttatactacccatgaacttgacaatttctttggttagactttaagaggtaaaaggcagaatcatttggaagaaaacaaatgtgcatagaaacatgagattgagctaatcagtactatcatttatacttattttatattgtatttggatgacactatcttatttttggctgtgttctttgatgtgagttgacaactaatctatgttcacagaaaacagagtgacatattatcacatgattaattaagtataaactaaaaacttaacaaatggattaatacgatttttaaaacaacctttatatagaattttttaaatattgtttaacatttttaagtgtgcgtgtggaaaacgagagattgaaggttgagaaccatcacaaacggactttaacattagtcggtcttagaatatttatagtaaaatcgtaacggatttacttagcaaattgcaaaggatagacaaatgtcaaacaacttgcaattttttacacaacaatttaaaacacatcgattgatagctacctgacgagactaccctatcaccagccagtccagcccctttggctgctaacccggtcaaaaaaacgatcaaaatcatcaagtacaggggacgatcgttcagccgttctcaccaaccaaacaatgaaaagaaaaaaaaaagccacaaatgtcaacgtgtcactaggaaaagtcaaaataattccctcacttttacaacccaatcttgtcgcttataattatgcatatcagccaaaatttaaacttttaactttaaatttggagttaattctaagaatttttaccgaaatttatttttcagtctttatttttagatcgctaaaaatacgcatataaaatttatattcacaaacaattttcagtttgtgaatatatgtcctatggcttattcaacgacagggataatcctcccacgattttatttcattttcaaaaaccgcgccggcttaccgggcggcgactcgacccgccaacccgcctccacgcctacggagactgccacgcgggccccacccccgraaaccgccgcgaaaaagcttctcccccgggcccaccaccamccccccgggctaccgccgctgccgctgccgttgctacgcgtcccccgacaacgtgcactccctcttctcctctcctctccaattcgtctcctcctcctcaccacgcttgcttcgccatcccgcctccgcatcacccgccgccgccgccgcctcctgctcgtggtcgcggctgcgttgccggtgctgcaggaggtgcttcgggggggagatctcggtggggtttgctgcttgctgcttgaggtggtggcagttgaggaggaggaggaggttgctgtggttggcgaggtggggtggggcttggagtaagcggagggggaggaggaggggggtggggaggtggtggtcgtcgggcaggtggggaggatgtacgtgcccccgtcccgcggcggcgggggaggcgcggctggcggcggcgagcagcctagggtttaccaagtttggcggggaagcaacgtaagcgctctctagctctctgtctctttctgtctagcttcatggagcaattcgattttgtttgcctgtgaacggtggatctggatctgggcgcgcgcgcgcgagattagctgcagcttttagggaggatttttagccgttttattatgtgactgggcgcaggcgtgggaggaaatgagatgttttcggtttcacgtgttcgcgatttgtgtgatgcttatgttcgaaatgcgagtttaggggcttggtgtgacagaaatttgagccgtatttgatgcttactgtagactgttcgtgttctagttgtttatggttgggaaatatagctctggatgggtggaaatcagttcatattcgaatcatgaaatgttgatacagctaggggaaagtgtgtgctttctattgttacgagaatacacagcagaaaatgttttatatttatgttcagtgcttcagtttatttatcaggttgggtggggactggggaatgctagttcattagtttgttggggaagctacttcaattttcagaatatgaacttttaatgactcttacatgattatgaggatcatggaatggggactgcagcttttggtagtacaatatgttgggaatgtttgatacagaaagtaaaatgttttatatctgttgtgcagtgattagttttggcgagaaacacattatatattggaccgtaaaatgctttggttggaaatgtgttatgctctatatttctcgtagaactgaaacataccgagacaatggtaattttggtctaattgtctaaatgatccttttgattcctttgatggggtacttggatgcatttttaagtagaagaatttattcaatgatagcttctttgatcctttttattcctttgatgggatacttggaggcatttttttaagtagaagaatttattccaggatagtgtcatgctttagctcatctacagagtggtctatgcacagcgacctttgtacatgattcaatcacattctggcaggtgtaccgtcaataaattagtgcacgcttcgtctgttgaacaagaggtgaatgaggcatttgtgtatggagattacctcatattaccatctcgttcctggcatctccgtttcactagattctccaattgggacagcgtgcaactagaacaaacaatccattcaaacatctgtcatctgcatagtagtgtgcttaaggttgtgattagccaacgatgtgggatgatgaataatcttgtggccttataaagaagcaaggattaggaaatctttctgggagtttggatgtactttatttttttggcaagagtgaggctgttttcttattaaaaaatttcttagcttgtggatataattgtccatccacctaattttaacaagctagagaagttcttgatatggtacacattccgtgcttgggagaaacagctaggaatgtttcatattacaaagccgctgagttacatttttagatatcatttcctgtttctgattatttggttgttttcatgagattttagttttcttttgcccttctcactattagtgttagcagcttttaaccttgctatattgagacatcactatttaatgccataaagtgccacttttttggctaatcgactctgttttaaaaaatagcatgctgaccgttttttttataaattcacttatatatttgcaattatttcttctagtttcacgcattggattcattgataacaattatggatctttttttcaggagtttttcttgcaaggccggttcatttttggaccagatgtgagatctttgtttctcactatattcctcattcttgcaccagtattagtcttctgtatatttgtggctagacatctgatcaatgacttccctgatcactggggagtttcagttatggtcgtagtggtcgtcttcacaatatatgtaagtattgctaatttgctgcttctcatttttttttcctgttccctctaaattgattgaaggctgtcttagttctgctactctgaatttggttcatatgacagttcaaccatgttctctttatctcctagcgcttgcatgatcagtaaaatttctggccatgaataaaactattatgccaagggtttttattttagttagatgattatcaaaatcggataaatctgtcaaaagtgatgcacattcatgtgtaaagagtaacatagtataatgtgtatgggaaacacataaaaatgtgattggctactcaaacattgttatccatatgaaagggagttatgtgccgagtgaataaattactttgacagtgtaatttattatgtttggttgtttgctgcatttatttcccgagtgaatatgcactgctgcagtgtgtgcaattaactgaagcttcatttaattttccaggatttgacattgctgcttcttacctctggtagagatcctggtatagtaccacgtaatactcacccacctgagcctgaatcgattgatggaggcagtgatatgggaaatggacagactccacaacaactacgtttaccacgcacgaaggatgttttcgttaatggagtaattgtgaaggtcaaatactgtgatacctgcatgctgtaccggccacctcgatgctctcactgttctatatgtaataactgtgtggagcgttttgatcatcactgcccttgggttgggcaatgcattggaagggtaagtatcttgatgtgttggaaggtttaagatatccttattgcaattagcttgaagatttgatatcatgtgcggtgttgtggtctgtatacctcttgttggattttctatattagatattagtagattgttagttactactttaaagttttaacaagtcagcgctaattatcaacttatctgctgcagcgaaattaccgattcttctacatgtttgtattctcaaccacattgctgtgcctctatgtctttggcttctgttgggtgtacattgttaaaataagagatgctgaaaattcaacgatatggaaagcaatgttaaagacaccggcatcaattgtcctgatcatctactgctttatttgcgtgtggttcgttggtggtctgtctgtctttcatttctacctgatgagcaccaatcaggttggtatcctttcggtttttttttaagtttttacaaataaatctttcaagcatagcttaatgacttgttaaccgtccttttctttacttgtgtgtatcagacaacctatgagaactttaggtatcggtacgatcggcgggctaacccatataacagaggtatggtgaacaactttctggagatcttctgcactgcaattcctccttccaagaacaattttcgagctagggtcccagtggatcaaggtttacaacaaacacgcacgcctgctaggggtttcatgagcccgaacatgggtaaaccagttggagatcttgaattgggtaggaaacccgtatcatgggatgagcctcggtcagcagcagatatcagagatttggaagttggccttgggggtcttttggatgagaaagagggtagaatagcccatgcatccccagatctttctcttccgggtgagcttgtggaaggtagggctggtatgcattcgagacgatcaagttggggtcacagaagcggaacctcagagtcgatggacagcatcgctgtgcaaatgggaaccgaagctaactggggttcaatcagcagcggccatggtaccaccagttcaactcactagcacacatcactgcatttctgacgctgcatctgcatctattggatccatctcatgaatgaagaaccatgtgtgtactctcttctcctgtgctgcttttcaccttaggatatatacacagtgctttcttcctcccgtcctctgttgttgttccatcctggaatgggcatctattgatgcacatcctgttctagtgtctttaagcaaaaataacagaagatctttaactcaatgcgtggcttggattatctatctgtatatatcgagtctgtaagcaaggttgtcgtgtttggtttggtttggttttcgacgttctgtaactgtaccatgctgctcgactcttactcaagaaatactactacccaaatcatcctctttttctaatgcaattctttttcttcaagtctctaattggattgttttttttttctttttgggacatggtataccatctgcttcgcattcttctgcatgctgagctgctccttatttgattcttgtgttatctgctcaaccttttgtattcctttgcatactgagctgctcattggtactatgaattcggtgtaaaaattaacttcaaattcaatttgctcgaaaactttcattagcatatactccatgtaatttatccagaaaaacaaaagcccagttgcaattgcaacgggggtgttctgctgggttattttaatacagatgccactgaagcgtgtgcagcatctggctcgcgccgaccaatcactcaacctgcaacagttgcaacagtgggcttgtgtgtttggcatgctttccaacgcaaaaagggcacatgctgagctgcactctcctgctctcgcagcaatgcaatgcagaagcagcgtcgcttttggtgctcccatgaaaattctgtggcatcgccagtgccaagcattcaagtatattttgtaccaccattttcttgctcataccagagaaaaatcatcataagaaactttgtattttgagtgttcttctgtgtgtcatgatcatatgttcagtgaggcatgttcttacatgtttcacagagcttcagttccgctaaaaaagagagcagagtgggctaaagtgatcttaaaaaattaaactagaagggtgaagcgagtctcgggccactccacagctacactttagactccgctcctaaagttaggtttataagttagagtcctataaaacaaactcgggtttatgacgattattcaaggacaaaaacaattaattatatattagaaagtcgaaaagttgttttataaaagttttctaagaaatgttgaagtttttttttggcaaaaaaaatgtaatatttaggaggctggaaagcgtgcccacgataatccataagccattgtgttaggtcaagttggatcgttgtgacacatcagtcaccaaatcaaaaccgttccaaccacagttaagtacagaaaatctgaatggattcatgtgagagtgaataaataatcatcactaagaatcaagcagaatcaagcaggaaaatgcatgtttgattcccctgccaggagttcctgatgcaagcagatgaagccagtaagtacgtagtagtagtggcctccagctcgagcagcagtgcagcactagaactgatccagaaacatcaaattttccaacaaatcaaagttcagaaactggcatgtcatacatggaaaattcatactcctaagtgcctgcacctgaagatcctgtggatacaagcaatggtgtatatttggcacacaatccaaataattaactagagcagattccattgagtggcaaaaggagatgatatgatcaggttagtggcttgtaggcaagtggagatcaatgaggaggtgaggaggagatgaatcgtatctttggtctcctcttatcttcttctttttgaatttaatcttcctttccaataattgaaatgttcataattcatcagaacattataaatgattaagagttaactatctagttcttcaattagctcaagggaagcttctgtcttctcattgatacacatggtaccggcagggtttcccaaaccaccggggccggggttaccacgccccggcggtaggtaaccgtgaaaaaccatgcaaaatttatcaaaaatttaaattattttttaaatttatttgaatttaaggaggttaccgtggtatttatattaccgtaccccgcggtaagtccggtaaccgcgcagttaccgacggtaagggaaaccctgggtaggtataggtaggtaaccatgtaccgaatagctggataagactgtgacaaactctgcattttgccctcctttttcttgtgctgatctgagaaaagaacacatttatgcatctgcttaactagacccaagaaacgtgcacgaatacacatcagctcagtactctccgcagaaaagattttctcaggcttgtcttcagccacagcaggaactccacttgatcagtaataatgcatgcatgcatgccaagcacttactagcaacactacttcttcttgttcatcttcttcgtcgccatctcgataaaacttgccgttcttggagaaagtaaaggcacagttgggcagctgcattattgaatggttcagctattcaccagcatgctgaaaattattcagctgttcagtagctagtagaagcagagaaggtgccagtgaaacaagcactgaaacatttccgtttcatcgcctcctcattgccgcgatgcagaaaaggcctcgtcgctgcatgcacataatgtattaccaccaagctttgatccgacaagtggcaggcaaatgtgatttgcagctgtaaagcaagtaaaaaaaaggtataattgtccatggtttgatggtgaaatgtaacttactgatcaaccagatgcaaagctagtttcagctggtaattaactttggccatctctgatagatgcaactagcttaattgtgttgtgtttctgtgactcttgtgtgtggtgcatcatgtatccacatacttacatttactctttgtgttcatgagaattggcatgcagctagctagcagcattgctgaacctgaatgctgatcagttcagaaaaaatcagatatgagcgccgatcaatggatggaaagagaaaaggcctaaccttgactgaaccggccacattgctatagtgctgtactgttgtctgcatgcatgcatctctcttgtcagtgctggtcatggatgtgtattaacagtagtagtacattatgtaatgcgtctttgcaattaaaatgcacagtatagtagtaacaaaaacatgcccttttcttcccatagttttggggtccatgcaggtaattcatgtgcagattctgatactgatgatctgacagactgacaacacatgaaacctcagatgcaactggagaagacataatttgattacactctacaatatctaaatatgtctctcctatgtactaactttttgaatacattcctgaatttagttaatggaaggattattatctgacaaatgttcaattattcagtaagacttcaggttatagcaaacagtaggagtataatatctctggaccacttaggcacttaggcaccatgtagatacgtacatatgtaacatatgagaagaagagaagctctactactatatatacaaggcttctacccccaatgccaagcacacaaacattgggtgcagtagtgaatcctcttcagaagttcagaaaactatagcttgcttttagcatatataaattaggtgtttttatcttcttttgagaaggagatcaagaacaggcagtaggaggcctcttcctcttctccatggatcacctttgggcctctgtctttgggattcttggtaagcatctcatgcatgctagttcaccatctatacatgcatccatatggtagcatatggcatggcatggtctcccaaatcatgattttgtttaattatatgtatgacctcaagatatattattcttactgacatgcatgaaaaatgcacttttcttctccacaggaaacatcgtctcattcctggttttcctcgcaccgatgtgagttttgctcatttacgccctgattttttcttttccaaatcattcattcacctaaacttaattacgcgttctgacaagtgcacaattaaattttattttttactaaaaaacttaactacgcgcacgtcctgactcctgacacgcgtgtagttaagctttgtcttgttcttaaaaaaaacaaaagaagaaaaaaatctcaataactacgcgttgtggggattgtgccagagttttgaatttcaaaacatgtctttttgccagtggggactgaaagaactgaaatcaccgaaattttggtaatttcggattttttttgaattttcaacatattttgattaaatctgaataaatttacaaatatttgacaaaaaccgaaaatttcggggaractttgtgcttgccggtggggcccgaaattttcgaaccgaaatttcaaaccaatggatggtgcaggccgacgttcctgagggtgtacaggaagaagtcgacggaggggttcagctcggtgccgtacgtggtggcgctcttcagctgcacgctgtggatactgtacgccatggtgaagaccaactccagccccctcctcaccatcaacgccttcggctgcgtcgtcgaggccgcctacatcgccgtctacctcgtctacgcccccaggccggccaggctcagggcgctcacctccttcctcctcctcaacgtcgccgccttctccctcgtcgtcgtcgtcaccgtcgccgccgtcgcccagccccaccgcgtcagggtgctcggctccatctgcctcgccttctccatggccgtcttcgtcgcccccatgagcgtcatcgtaagaagctctcacctcatcgatcagctcttttcttttaaagatatataatgaaagtttttattgaactcagccaattacatcatatgatattataactgtagtaagaacattccccaacttgaactcaactcatcagttttttttaatataatgaaagcttttattgaactcagccaatattacgtcagatgatacaaccgtgctaagaacactttcaacatgaactcatttcatcagtttttttttaagatgatggaagctttattgaactcagccgattacatcagatgatacgatcattagcttgaactcagctcattagctttatcttttttaagataatggaagttttattggactgagccgattacatcagatgatacgatcgtactactgagaacactttcaacatgaactcagatcatcagctagtgatgatcttgcatcgtacttgttgagacatgtttgctgatcaatcgatcgatggatggatggttttgcagatggtggtgatcaagacgaaaagcgcggagttcatgccgttctcgctctccttcttcctcacgctcagcgccgtcgcctggttcttctacggcctcttcaccaacgacctctacgtcacggtaattaaacatctcgatcgatatcacatcaaatcttgatcaattctctcgaccaattcatgaatttcaatcaaagtttgaattgtttaatttgcgtgtagcttccgaacgtgggaggcttcttcttcggctgcgtccagatggcgctctacttcaaataccggaagcccaatacggctgccggcggcgtgatgatcctgccgacgacggcggctgcggcggcggtcgacggcgccgtggctgagcctgcggcggcggcgcagcagctggcggaggagctggaaatggagctcgcggccgcaggcgcgcacgcggtggccgtgctgccggcgaacgcgctgcccgtgctggccgagctgcacaagatggagcaggagatcgggacgccgcgcaagggcgccaccaagaccgtctgacacgtggctcgcctccattggttgtcgagtgccatgtcatcatcgtgattattatatatatgggcaaaatgcatcatacccagtagtaaatttcttaatttcagctgtttgtttgcgttccatttgtgtgtttgaattgagtttgtattgtgcaattatcccaagaaaaargaaatgtgcatgtattggttatgattaattaaattaattcgtatcctatcaagcatagttgcaagtcgagactatcttttttcttcctagccattgggtctccaatccaaaggtgagacagcccatctgaacttcgcggtccagtcagcccaagctcattaggcccagtatctctctgcaacatttttgcatttttttttctttctttgataaactcctctagtgaatatgtgcataactgaaatggacgctggcctgacaagatcaaattaaaaccaactcttatgtttgagccatagctcacaagtcacaaaacaacaagtgattcaaacaaatcagaaacaataagtactccagtgatcttgcagggggaggcagtattctatccaagcagactgtttgctaataatcttatgaccatgaggccccagaaaaaaaaaatcacatgcactattttagacttcccaatttatttctacacataaaatttttaaaagggaaaaaaaargagaaagaaagacgagaccacacagcagcagctagtgcttgaccagcctcttctcccatgtctccactccagtccaagccgattcacatgcatttgttctgttgcatgtatgcttcctcttcctcctctcctctcctctcctctcctccccatttctcatcttctctctctttctctcttactccaatctgatctccattgctcaccttcctagtagcttagctgatctcaatggcgacaatggcgagctcaggagcagcagcagcagccatggccgtgttcttggcaatggcgctggtgttgagtggcactgaggccaggttcctgtccaacaacatcactgtggttggctctgtctactgtgatgcctgctccaacaacactttctccaagcacagcttcttcttgaagggtgagtagaaatggtagtatacctgttacacagtagctcagctgcattagagttagttttgatcaatgtgtcattctgcattgtggtcaatcaatggtttgttctgaaatatggtggataaacatggagtgtttttacagcaggttattctttgtttctgagatagatttacaagatgctgtaaatctcttgctcattgcacagtacaaccacatgtaggatgtcttagaagtattaggttttttttttctgttctaggaagatgtcactgaaaagtgaaaactaataggcaagcgtgacaagacttctttttgagtacattgattccctatgaatctaaaggagacagagaaaagttgacatatgcacaattgcacataaatgtgtctgtggcttgttctggatttataattggtctggtcaattttcttggtccaattgtaattgttgtttagttttagttaatgctaccatgaaagacaagatgcctcacacaatataactcaagtttcttaggcccacttaaagcttggcatacactaactgaagttgaaatacaactgacaattactacattgtgccttcaattgcataaatgcagtatcatccagcttctactacccatctgggctctggcattgcaaacagaagttttaactggctctgagatgtgcttgttacacagtttcaattcagagttttgatcttttttttaaatggaaaaaaaatgtttctgtcggttattttgagcgggatatacctctaaatctcataatgctatgcaaattacaatgctgcctcaagctagaaatttccatgtttttggctttgttctaaaaataacgatttcattatcctaatagaacatagtgtctatgagttgccaaagtatgacattgcactatattaccaatgcctcattctacattgccactaaaactaaagctaagatcattcacaagagcagctggtttcatagatttcatcattgcattcaatctgaaatctgaacaagtaaaaatcagtaacttaccagatatgaaattgtcttcatctttggcaagaactgagatgctgaagccacaccactaatggccaccatggtgatggatgctgtgcaggggccagggtgctgatccagtgcagcttcaaggtgaactccaccatggccgaggagctgtccctggaggcggagcgcaccacggaccagaacggcgtgtacaagctcgacgtgccggccgccggcggcttcgactgccgggagggccacgacctccggtcggcgtgccgcgccacgctcgtccggagctcctccgccgcctgcaacgtcccgggcctccggggatccacgcagcacatcgccctccgctcccgcgccaccaacgcctgcttcctcaacctcaacgcgctcaacttccgccccgccaagcgcgacgccgcgctttgccacggcggcwatggcgccggcgccggcggcggcgctgcgttcggctcgtcgctcttcttctggccgttcttgccggttttttggccgccgtaccgggtcccgggcggcggcggcgggacggtgtcgttcccgtggccgttccccgtgcccggactggctggtgccaattcctggsggccgccgttcttgccattcacgctgtaccagccggcgccggcgggctccgggccgccgccgttctaccgcttcccgccttcccaagaagcatcaccatctcagccttagacctgaaaaagtacaaaaaaaaaacttgccaagattaatcctagattcttcatgtttagcagcaagagaggttgtgtgattgtgacattgttgtaggtgatgattctccctgcatcacacgtgtagctggagctagttcaggaattgccaccgtgttcatcgggctgatgaatatgtggaagtgataattataatgtagtgatggcaacttgttagtagtattcggtatattgtcttaaaatatttcctcgctgcagctaatttttcaatcatatttatatactgatgaatgatattgcagccgctaacactatcttggtactctttttttttacgaaccggcacttagaatgtgccaatttcattgaatagagggagaaatcctgataccgtttttctcacaatttaaacttcattcctaaaggaaataaactggacaactattttgaaaccgagagagtaattgacagatacaaaatagtaaaacttgtcagttgggtgaactcatgaaggtatatgcctgattcagtccagacatgaaccaaggaaaagtttcttcgtctgcgtgtaccagcagagtaactacccaatttgcatatggcacgaggaacaggtacacatatgtctctaaccgactgctgaaagtagagttcatcagaattgattgcttcgtcttgtctcgcggattttactggcatggaacatggtatgttttttgccaagcccaatggttttttgatttcttccagtggaactgacagtgcagtttgacaaggaaaaggggaagcagacacaagataggacacggtctgtttcatcatgtaaaaatgcatggttcagaagtaatttggctcctggaaacacttcgcagtgatgacatttcaaagttcagtttgattcaactattcagcaatcggttccaacatacacaaatctagctctgttaatctgaataaatattctcaaccaataacaaatggttaaacttatacggagtatattcttagacccaggagcagatgtgtcaaattgaggagagttgacaaggactaggcgaccaagactgaatccataacaaaacaaccgaccatttggagcgttgcattgggtgagaaaaagaacaaagaatcctgtttaggctaaacaacccttgtggctggggagttggacacctccattctaagtacaatcatgcacacaggtcaagaggtgtttatagctaaatctaatgcattattgacatgacgccactggcctctccaagtcggccatggcgtcactctttgcacacttgcaactcctgctccagttattaaccttccggtgctgccgtacctcatgtatactactaaatcactgcatccatggaccaagtacttaaatgctatatatgcaatcttcagttgtacttaaattctatatatatgcaatcttcaattgtacttcaattcaatatatctactctttaattgtaattaaattctatatatgaaatcattaattgtgcaagaaccatggatatctgcccccaatccaaaagatggcctttggaccaagaaccttgcttggtccatctatatatatcattcaccacctctcctttcaccttcccacatgttcttgcttaatcctttcactaaatgtgtaaacaagttgtcgatgtgccaccattagaaggagcatttgcaactttgtaatcactagctaactaaaaagaggaagctgttgtatacgtacgtgagcgtgggcatggccgagaagaagctggcaatggcggagagagggcggaggggcctgatcatgaagacgctggaccggtgccggccgccggcgtggaggaggccggcggaggggtgcctctcggtgtacgtcggcgcggcgcggcagcggttcgtcgtccggacggcgagcgtgaaccacccgctgttccggccgctgctggaggaggccgaggaggcgttcgggtacgcggcggcggggccgctgcagctgccgtgcgacgccgccgtgttcgccagggtgctggagcagatcgaggaggaggaggaggagacggcggccgccggcgacgtggcggcgaggaggtgcggcctcgccgccagagggcactccgcctaccggctgctcgtccccggcggccggcctgccctcgccggccggtcgtaggacggtgcagacatgcagtggagtgtttcttgtccatcgacttatcttgagcttgtggctctgatgataaatccacctaaatcaattaatgtatctgcaaatcatgaatattgcaacaagaggttagtgcttagtactagtagttgatcagatcttgggcttgagtttttcttttgttgagctcatattcacagaagatatgtgtatctcttaggtcgcagtaactgttgatcagttgatgcaaatgttatatattcaaattccctagctttggatatttatgatacagatttcccaagctttgaatgtttatgatacaaatctccctaacttggaatgttttatggtggaatgatgcttagaattataaataggttgcatatttgaatgcatctcacattgataagtttgtagtttttggcctcctgcagttcacttgtcaattgtcatgcatgtattcattatttttttataccaagcttctttaagtctactattcaatacatataatattaaaaagactcaatgcttcaaaaaccaaataataagtcaagatagcaattagcaagcaacacagcagaaacacggtgacgagtggaaaaatgggtcaacaatggacaaagaaccagtactaaccagcatgtacagaagattgaattcaaaaaaaggaaaaaaaatctagtgaatcactgcacatacctcctggtgctttgcttggcttgctagaaggttgaatcaacataagggactacaagtattcagcaattaacatctactgaggcagcacctatgctgttattttcagcagcacttgagggacattttgtcaaaaaatccaaatctgaaaatttcaatgtaatatgatatgcagttaatgattaacttttcttttttgctgggtcggccgaaaatcaaccaaccgaattgtattaagaagaaaagagagagttcaggttacaaaacgacattaaactgttgaaaagggcaaacagccaaccacgaaagcagcaaactgatgtccctaaaaggaaaaaagcctgggcacaactaatgtttcagtgttaacttggataacgaaaacaacagcatagaatttaaaatggctaggttccctgtacttttgacatctgtagagtcaaatgacaggggccacattgtttcgctagccctagtatcatccgaaaagctacaactcagtctaagactcggtaaataaaatcaagcagcaagaagaaaatgtcttgttacatgaaacgggctgacctttcaaagaacaagtgttggaggcgagaagtttttttcttatactcgattggaggcgaaaatggttgtgaaaattatacaatctggcataacaaaatctggcaaatcaaacaggctgctggttgtgtcatgtatgtgatcttaagcaaggtgtgggtaaaatattcactctttagatgagttttttggatctttacctcaaattcatagagtcctggttttcaatacttgcctcaccactagaatgtcttcagaatatggattctgaagccgtcaatttgtaaccaaattacaagaagaatgcagttacatggtcgcatacttttaaagcatgtgcagtaattcagattaggcataccaagactgcggttgcgtggtttctgctctacaaagatatcgcaattacagaagttctggtgaagaaacacaaagtacacacccttgaaactcctgaaactgagttcacttattcaatactcattgagaaacagtgactctmaacctccttcaggcggcctcctctgttgcctctgaccactgtgctctccttcttcattcctgcgttgactcgccaagggcgcagcgctttcgctttgaggccttttggcctaagtttgagggattcctccaagttgtgcaggacgcctggcaacctcctgctaaccttccccccctccccgcgcttgcctggtgtttctctaacacggctaagcgccttcagagctggagtgatcgtcacgtcggtagcgtccgcctccagctgcagatggcgaaggagctcatcttccgtctcgatgtcgcgcaggagaaccggtctctctcccccctggagacctggttgcaacgagacctaaagttgaagtcccttgggcttgcctctcttgagcgcaccatcgcccgtcagcgttcgcgtctgctttggctcaaggagggtgacgccaacaccaagtttttccaccttcacgccagagcccgaagacggaagaacttcatctcacgtcttagagacggggactagcttgccgtcacccatgatgagcttcaagagctcgcctcttctcactttggcgccatcatggggacgtgcgttgagcgcgagctcgctcttgatctccactccctcggcctctgtccggcgcagcttggggagctggacggccccttcaggaggtgtgggcggtggttaagtctttgccttctgacaaggcgcttggtcccgatgggttcacgggtcggttctacaagacttgctagccagtgatcaagtcagtggttttggcggctcttaactcccttttcctgggcttacggccagggtttctcctccctcaatgatgccctcatctctctccttcctaagaaagatgaggccgttgacgttcaagatttccgtccgattagcctcattcacagctttgggaagttgttctctaagattttggcctcccgtctttctcctctcctcgacgggcttgtggaggccaatcagagtgccttcgtcaaaggccgatctcttcatgacaactttcgctatgtccagctcgcggcaagggctctccatgccagacgcactccccgccttcttctcaaggtggacattgcgaaggcttttgacacggtcagctggccgttcttgcttgaggtgcttgcccatctagggttcagtcaatgctggcgtgattggatctccctcattattagcgcctcctcttcccgggtgctgatcaatggggtgccgggtccgcgcttccttcaccggaggggtcttcggcaaggagaccctctttctcctatgcttttcattctagtcatggaagtgctcaatgcgatgcttcgtaaagcctctgattcgggcgggttccttccgcttaatgatcgcgctttgcgacaccgcgcctccctctacgctgatgacttggtcctcttcctctccccggttcggcaggatctcgagttcatccagggcattctctcggtctttggtgcggcatccgggttgcgcaccaattttgccaaatgctcgattactccgatccgctcctcggatgaggacctggagctggttcactcttgcttcccctgctcgatttctgattttccttgcacctacctcggcattccgctgtccgttcgcaagttgccgaaggcggctcttcagccactggtggacagggtcgctcatcgcctaccaccttggaaggggcgtctcactactcttgctggtcgctccatgttggtccagtctgttctctcctccattccagtccatgtgtctatggcaatcggccttcctgcctgggttgttaaggccattgacaagaagcgacgcgccttcttgtggacaggtacagattcggttcatgggggatagtgccgggtgtcctggacgaatgtctgtcgtcctaaggccttcggtgggttaggaattcctaacctcaggttggcagggttcgccttgcgcgttcgctggctttggcttcagcgttccgggcatccctattgggatggcttgaaggccccggtcgagcagtctgtctccgacatgttcgaggcgtccaccttcttcgtgccggaggatggtgaatctatgctcttctggactgaccattggattgatggaggccactcagtggcctccttggctcctgacctcctcttcgctgtgccacagcgcctccgttcgcgcacggttgcttctggtctggcgaacaactcctgggtttcggacatccgcggggccctcactgtccctgtcatctcccagtttcttcttatctgggatgctgcgctccgaattcagctcttgccgggtgtcagagaccgtcttgtttggcgttggacgagcgaccagcgctactctgcgcgttcagcgtaccaggccttcttttttggccagcactcctttgcctgtgccgatcttctctggcacgcgaagggccctgctaaatgcaagttcttcctctggtttgcattttagcggcgctgctggatggccgacctcctcctaaagcgcagcttggatagtcattcggcctgccccttctgcggtcaagagcttgagacagcgaaccacatcctcctcgattgcgtgttcgctctgcaagtttggctccgtgtgctgtcgcctcttggttggactgcctctctgctctctggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctccaagctatttggagttgtgtgtagccgtcacagtagtcttttgtctcttctttattttagtcttttttctcccctttcttggtataagtcggtctgactgattgcgtcatgtaacaaacattctattcttctgatatattgacgtgcaattcttttgcgcgttcgagaaaaaagaaacagtgactcagtgaggcccataggaagatatttgatcaagctctaaattcaatagtccctgacaggttcccaggcatagaactttattcagaattttggacgattgcctcaacaaactttgaaaataggtaaaaataccaatatttactggaacctccattcccaaagtcccaatctacaacttgcaataaaaaccaggcgattacagtttctccccgaaaccaagtaatcctactgaccaccaggggagatgcaatgcatcgcaagacataactgtcggaatccccaagcaaaccgcacaaaaatcgcatcgcatgaatactagcgcgctatgatcctaccagtacacagagcacgagtatggaaggctagttgttgatgacttgagatctgcgaagagaacgaacagagcgagggagattcacctgggaatccccgcgcggtggaagactgcgaatcgctctccccggcggctcgccgtcgccgcctcgctccgccgccgtcgccattgggtttaccggaagggcaaacacgcaatatcaaagtacacgaggggtctacgtggaaaagtaccaaacaaatgggctggactcacaatcaattacggcccggcccagtagataccaccacctcacactccattcgcgaggcccacggcccaagtgacgcctcctaaaccctaatcctggcaacggacggcggatacagcccacctcctccccccacgccgcatccgacgctcacgaagcgtccacgtctccccgacgattgctttataaaaccaccacctcctcctcgcaccaccagtcgcccgccttcttcctcctcctcctccgccgcccgcctcgccgcctcccgagagctccaccctcgcctccggcgaaatggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgcaggcaccgaagcgaggcggcagggcgccggtgccggcgaagaagaagacggtaatgctcgccgtctctctgctcgaaatctacgttgtttcgttgttggggggcttgtgatttacttggatgttttgcttggtggttcttgcaggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcggtatatatctacatctcagttcgttcatcatgtcggattgcacctggaacgctaattggccgaactggttaggtgttacaaatgtcatttccttgttaggtttgtaattgtagtgactagctgatgaatgtgtcttcagtttatgatgaccttttgggtgttctagtcgaacatagttatctcaaattaatgctggctgtgtcggtattcttgttggcatggtagctctctgtccaaattttattctaggatagaatgttaaccctgtgtcaaaagtggtgcttttaagaatggaaaattgctaaagcagactattgaagttttgctgcagtatatggtggttgtcagtttttatcatgtttctgtttgtttatcactatgattagactcaacgctgtctcttcaacaccattgttatgtaggatcgtgttatcaatttcttagttgttaccatttcaaaaatgaagcaaggaaactcatctgttaaattgttaatttgtgttgaggaattaatggcataaaaaatatctgatgtaaatctttatttgcagcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcaggtacaggagcttgttaatgtgttcatttctttgttagtcactcatcaaggagacttattcatgggaacatataatcaagcactttactgataatttgaatgcttctcgcgcagagcaaggcccagctggttgtcatcgctcatgatgttgatccaattgagctggttgtgtggcttccagccctgtgtaggaagatggaggtcccttactgcatcgttaagggcaaagctcgccttggatcggtatatttcctgactctccatactcaaattgaatgtacttattgaaagtatagatgctagtagaaagcggagctcaaccttcgcaaatgatcatatgcagattgttcacaagaagactgcatctgttctgtgcttgaccactgtcaagaacgaggacaagcttgagttcagcaagatcttggaggccatcaaggtaagaaaccacggcatcccttgttctctcattcatgatcatcatgttatccagtgctctgctctttagcctcattgctaactcggtgaaccataactttgtaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaaattatattcgccccccgccgttgagctcgccctgtagtttcatttttcagtgtaatgattttgacgaggaactcagttagcaccatgcgacagtgctgtggttttctgaagtctagtttcatatattttctgttcaccgggaccatgttgggaaactatgcaagatatcagagctttacaatgtttggtttctacgcagtttatgctgtgtgttttgctactcgtttgtttgccttggctgaacctggaacatagggcttgatcactttgatgccattttcagccttatcaaattttggtaaagttacctaaaaaaaagtggatatatttagtttgctgcctaattttggtaatgttaaattttggtaaggttttttttcatcaaagtaaatagccccataaagttcatttcacagccttacagccatttaatttaagcaaaattatgaaagctaacatgttatttttttaattttttgtaatgtcgaaagttcttggtagttttgcattagttgaaagtcaaagtcatacgaaaaatgtcaattttgatggatatacataaatctaagatgcgagctcgcaaaaaattccgaaaccgtaagtttatattgggctagtagtaactctagattaggcctagcccaatttggacagttggcccaagattttacttggagctcaattatggaataagttcaccggagatccctcaacttaacagcgagattttttgagatctcttaaccacaaaaccagaaatcttcacctctaaactatacaaaaccgttcactcaaggtccctaggcagtatatatgagtggtttcgctgacgtggcatcctagttagccaaaaaaatttttttcttctcttttcttctccttctcttttctctcttctctatttctcttctttagtgagagaggccagcggcaggcgcgcttctccttctcttctcttttctctcttctctatttctcttcttcagtgagggaggccggtggcaggcggagcaacgcacgcagatgcgggtggcgcagcagagggcaagcgccagcggagcggcggcgggcgcaagcgcggcaggccgagcagtggagcgcgagcacgaccgcgggcagagaagcggagggcgagcgcggcggcgggtggagcggtggagggcgagcattggcagcggagcggaggtgggcgagcacggaggcgcatccagcccaccccaaccgaccaaagcacaccctttgccctcggccataagccccgccgccaagtcgccgtcgccgtcctcctcgtcgtcgtcgagcggcagcgatgacttcgcggtgctcctcgacgcggagctcaagctcacctccgccgctgactcgacctccgccggagacgacgacttcgaggaagacccctcccagccttccctccttcctcctcgagctccctcacgccggcgcccacgcagggatgggaagctaacagtgctggtcgtcgtggtcagctcgcttgccgcggcaacgctggtcccggcgctaaccggctgatgcgtctgcggatcgatgccctggctcatgagcttgcgcttgatgtgctgttccacctgcagaaccaatcaatcagcaccaagaacacaagaagagctaaccggagcagatgacaacacattgaaatttgttttgcttacttgttgccgagaagggcatggagcttgatggtgagctcgtagtcgtcgtcgatgaaagttgctgcacttgaggtcggggctaaggtagttcatccagtggaggcagcaactctttcggcagcggagcagcaccatcgccttggggarggagagagggtcgacagggaaarcgcgccgctcgtcgggcggcsgccgggcccgtggtcgagcacccagcacattcgaacatctccgccgccgagctcaccgttgcgccgaccgccatctctcttccgctcccgccgccgccatcgcatcgaccacctctctcttcctctccgccgccgccgtccccgctccgccgccgaccacctctctccccccggtcgccgcgcttgctcgagactcgagagaactcggagagaagagaagagaaaaagaaaaaaaaacaaagaaatgtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcgcatacacatttcaagattcaacatttaaaacatttaaccaacacttagtataatattaaatgaattttatttgttaaaaaatatatcattagattgaaatttaaattactttcatatggttataattttgttgctacacttagtataatattaaatgaattttatttgttaaaaaatatatcattagattgagatttaaattactttcatatggttataattttgttgctacaaaccttctaggatatgagaaattataagttaactttgaccatgccttatattatgggatagagggagtatatagtatgtgaatttgggagactgcagttgtgtgttcttatttctcttaagctaataacctcactcgtctttttttgggtagaatgttacagctatttgatagtagttctgtaatcctatgttgatactgtctaaattctatggctttgtgtttcttgcagtaggacaatggaggggagtttgagattggggtttctgttggttctatgtatcttggccttcttgcgccctgctgcagctattcgcttcgtgatcgatagggaagagtgcttctctcataatgttgattatgaaggagatacagttcatgtatcctttgttgtgatcaaggcagagacgccatggcattataccgaggatggcgtggatcttgtggtatgatcttgtttttctttttcttacgtccaatcttcatccatgtaaatactccacaattgtagagtgtggtgagattcttgctttcattttttaataaggaacaatagctggctagatatttccgttcttgtagtctgataatgggcatggaggattgcatatggactccatgttttgtttgatgcttgcatgagcccttgagaactttccagttatgccgcatccaaaactgattcaactttgatatatggcaggttagagatcccaatggtaatcaaatccatgattcccgtgacaagatcagcgataagtttgaattcatagttcataggagaggcgttcaccgcttctgcttcaccaataaatccccataccatgaaactgtagattttgatgtacttgttagtcacttttcgtattatgaccagcatgccaaagatggtaagcatttttctggttttgttaaatttgtctagcaaggagcatgtggttgattcctttactctggaaatatgtagaacatttcagcgccttgtttgagcaaattgcaaagttggatgaagccctctacaacattcagtttgaacagcactggttggaggcccaaacagaccggcaagcaatatgtatgttcctcgtgtcttactctctcctttaaatactagtactttttcgaaattgtaatatgtgaagatctcttgttttcttttatcttgtaataaatagaacttatgagttgtagcaaatgctcaacttttctgtttctgtactaccgacaaactgtcctgccttaggagctccagccttttatgtcaacctttggaccagaccgccacacatgccacattaccaaacatcttgaaattgataaatatttgttacattgatgaacaacatgagaacacacaccatcttcttttctttttcttttttttccctttttttttgtaaatatcatgttctgtcaaaagcaaaatttacagtatctcataaacgtgttttgatgctaaaactgtaatactatatttgtctatctgatgcagtaaacgagaacatgagtaggagggcagttcacaaggcattctttgaatcagctgctctcattgcagccagtgttgtgcaggtctacctactgcatcgcctctttgagcgaaagctgggaacatcgagggtctaattctctgatagtaggtctccttagactcaccaacccaactgtatttcaatgctgcaaaatgtgtttacaatatctgttacatcctgctcagatatttagcatttttgttcagaattttgtaattcagttatttacagtactgtgctgcagtaacttgccgcctcatcagattcatttcagcgcattatatctatcgtcacatgtatattaggtcctaagtatttccacggtacgcactgctttaaaaccttttttgcgatcaaggtacaggagtgctagtattgagaaagaaaatgaagaaagaattccttttctgacaaagactcctaaacttcagctcatcagcattctactttagtttcacaatttcagaatccatatttcgatgataaccatttagtatgaagtattcaacgtttattgagcctgtattatttctgtatttagctgtctggaggtagaaaagctcagacgataccaaatccaaggagatgacaccaaattggtttcttgctaacatcacaccatctgattaggatacagttggaagccatgtgcagtctggttggtcctaaattcttttgctgactggattttttcgtgttatggataatgatttcacaaataatgattggcactactgcttgagccgataagcataacaactctggtattcgcatttcaatgtccagtttggttggtacatggagtcactgacaatcgagtttggaatctctgaccaaacataacagccgcccgtgacacgtatcaacatcaaggatgataaccaataatcttgaatttttcagtaaattctgcctgaagcactgtactttgtaaagttgcatttcagatatcagcacttgttctctgaatcagttgtaactttgtcagtaatttagtagcctgaagccctgtactttgtaaagttgcatttcagatacacgaaatcaggcatcagcatttgttctttgaatcagttctaaacctgtgaaaccttttcatgagtgtgtgagctccaccagaacactacctcactgttcatccacagttcatgctgctgttattaagctcaacaaaaaccttgatgcagtgatgattgcatagtttcaagggacaaggccatcagtctctggatgaatctgaggctgaaaaccgggtcaagttttgtcatggttcaagagaaacgaatgccattgtttgttcagtttaaatcttagcttttacagaacaaatcctaccaaaatgtacacaaattcataaatattacaaacttgttattagattttataaacttattctgatataaaattgatggttggaattataaatatttcgattgaatcatatcctaaacaatcatatcataaacatcaaatatttaggcctgtttagattctaatttttttcttcaaacttttaacttttctgtcacatcgaactttattacgcacacaaacttttaacttttccatcacatcgttctaatttcttcaaacttccaattttaacgtggaactaaacacagccttatatcggaggaagtagttagctaacaccaccttgcaatttaattaatactatacaattatcatcaacaaaaagctcttccacctttcamtcttccccactgcccaccactgtactgtacccccaccattcctgtctcttctcttcttcactccactccactccactccactcctctcccccatttggccactagcttaatccctcctcccccattggaaggaaggacaagctcgaggagctcctcctccatggagcgacgtggtagcctgtacggcgtcgcggcggcggcggcggtggtggtggtggtggcaatggcggcggcggccggcggcgaggcggcgaggctgtcgccggagcactaccggtcgacgtgccccggcgtggagtccgtcgtgcggtcggtggtggcgaggaaggtgaaggagaccttcgtcaccgtcccggccacgctccgcctcttcttccacgactgcttcgtcgaggtgagcagcggcggctggcactgacccaaccaaccctcgtgttcttgattcagatttcaaaccggaattggaggcgtcagagtttcagagtcgcacttgcaccctcagattttctggttctaggtttcttgatttctttcgtaattgatagcctcggtttgatttcggcgagtagttagctttgcatttggcatttgaaaatccttgcaaaattttcgcagcttttgcagcttcagagctgcttgtgatgcactgaatttttcagcattactctgcattaggcatttgcatacttgcaaagcttacaaacttttcagctgctttcctgatgcattcaggattcagcttagcagcatgagcagcatgagggtctctgaattttcagcattaatctacatttaattgcatcagagatcatgtcaaaatttggtttgttagtctcagggaaaggagagaaaagctacttcctccgtttcacaatataagtcattttaactttcctcatattcatattcatgttaatgaatctagataaatatatatatgtctagattcattaatatcaatataaatgtaggaaatgatagaatgacttgcattatgaaacggagggagtagtagtacgagataatgagagattaacagtagattaatggtacgaaatggcaactggattagctccaaatcacgcactcgtcgcttctgccatgtgactgcacgacccttttctgtcaactgggctgcgtaatcaaatgctcacgacagatgcttctctgaatccctgctggaataccaggcgccacgttgtcgtatccgatgtggcggacacggaattccgtgccgtccacgtcatcattcctcccatttcatgatgatttcatactccgggttatttagatcgatgtcatttcaaaccatatttttttataaagttgttaaatatatacttccatttatttctttatcaaactccagtaaatacataagaaatcatacaaaaatttgataatattgttaaaatttggtaaggtttattttggcttcagtttaaacagacctttaaatttttgataggtgtgcaaatgctttgatcactttgaaaattgaagttacgtacgttttcaattggcactgaaattattttgggggaattttaaccttttctgacaggggtgtgacgcgtcggtcatgatcgcgtcgcggggcaacgacgccgagaaggactcgccggacaacctgtcgctcgccggcgacggcttcgacacggtggtgcgcgccaaggcggcggtcgagaagaagtgccccggcgtggtctcctgcgccgacatcctcgccatcgccgccagggacgtcgtcgccatggtaaaccatcccatcaatcctcctcctcctgccatggcgaaagctttgctgcctctaacaaggtcgatcaatcaatcaatcaatggcgttgcagtcgtccggcccamgctggaccgtcgagcttggccggctaraacggcctcgttctccaagtccggcggcgttgccggcaactgccaggcccggaaatgcgcgtcaaggaccttgccgccatattcgccaagaacaactcaccgtgctcgacatggtggcgctctccggcgcgcacaccgtcggcttcgcgcactgcacgcgcttcgccggccggctgtacggccgcgtcggcggcggcgtggacccgtcctacgacccggcgtacgcgcggcagctgatggcggcgtgcccgcgcgacgtcgcgccgaccatcgccgtcaacatggaccccatcaccccggccgccttcgacaacgcctactacgccaacctcgccggcggcctcggcctgttcacctccgaccaggagctctacaccgacgccgcgtcgcggccggcggtgaccggcttcgccaagaaccagacgctcttcttcgaggcgttcaaggaggccatggtcaagcttggcagggtcggagtcaagtccgggaagcatggagagatcagaagagactgcacagctttcaactgaacatagttgcatagctgcactgcgacatttgtaagttgtagcaattggggatttgatcgtatattaaaaatgaaatcatttcaaggtaagaatttcatactttctgttttcggtccagaagtcatggctgagtgatgaaagcgacaaaatgcctcttaagttaactctacaattaaattaaaattcaaaatagccacagctgaaaacaaccgaaaataatttttgatcgtttaagccacggatgataagctactcttgttgtttcaaattatttgtcgttttaggtttgttctaaaccaaacatatctatatttgactacaaatttttagaaaaccgtataagttaacaatacatgaattatatattatgaaaatatttctcatggtgaatctaaaaatataaatattgagatgttaaactatacgagtttatagaaattaatgattaaatataaaaattcttgacttagaacaaaccaagcaatttaaaacggatggtaaaaacaatttatggataaaaccttttattaccattcttaatagtttgaaaagccaatacccaaagataaacttcgatgcaaatatctgaatcaacactaaaatattttagttttaaaatttaaatgttagctacggttaataagttaacaacagtctctctctctctctttctgtctgcgcaacggcatgcgcaaatctgacgttcgcagccgcttgcctgacgttgatacgtgtagcttcagaaaacaaaactggcagagctttcttgtggtggtagggcaatggccactgcttgcttcctggggttgctctcctcttgctttcaagacccatacttttgacctaatcacccaaacctttccttgctgttgtctgaacacgggccatcttgggacctactcaacgcttccagcatgcatggacagttgccagtagcaatcagatgctactaaccattttcaggttcagatatcagaagatatacagagctttcagatcttgctgtcttaacaaggatccaggtgttaggtcatgtccagaatgcctgaattcataccgaaatactatcccgttctaaaatataagagatcttgaaagtgcaaatacattgccaaaatccctttatattaccgaatagttcaattatggcatgaatcaagaaaaatcctggttcccaaaacagagcccttgagacagagtaaccatcctaaccaaaacagaggcaacagagcagctccataagattggagacaatcagtctgacagtgccagttgagcaaaaacaagatacaaaccttgaaggaaaagaactctccaattctgaaacaattataggatagatgtaataaataataaaaccaaaccgttctttttccatatgtacaaagttttctgttaaagcttgccatcctaattataatatataaaaccatctaagcttgttgcggcgttacatggtaaaaatgttgtccgggaaggaaaagataggatggcaacaacgtaatgccgcccaaactcttctgcttgtatacacctccatgagaacctacttctcattcaacttcacatgtaggacatgaatggaggcttggaaaatatataccctgccagaagatacaatccaaagctcttgttatacgataacgttggaaataggtatgaatgcaataaagacaacaactcttaaaagcatgatagtgatgataatagtgatataggcatgatactgtttacagtcagtaggaccaagaaaggaattgcactgatatcatatttgaacttatttgggttgtaatagctgatcttgatggtgaacttaatacatccgcattaatttaccccggaaaattgatgtagaatactgttcgtttgtgagacaagcacatcaaggttggcagggaaattgaggttcagcttcacctgtattacacccatataaagtattttctaatttcaacaattaactagctatatcaatttttctagatgcattgacagtgaaatcttgaaaggtgaaaggaatacactaggtcaagcttaactaggctattctattcttcctgggaatctaagaaagctcttcttctcgattgtcactagttgcatttagttcctctcaagctcctttgttcctaagaaactcagcttgtatcccgtcgaaacgaacaaagttataaacttaagctttctggtctcctacttagcaagcacgaaagcgctcaggcatccatttcattgttatatggccctttttgactctatatgtttacagctcctttccccctttcagttcatatggtcggtgctcaccgacgcaatttagtcccttacgccctttcaatatcgaatttcatcaacctgaagctatagccagcctctctacatcaaattagagatccaaaacatttgagaatcatctggattgcatcgacaaccaccaattctgaccctttccacttcttaccatcgcgtcaattttattttaactacgacaacaagctgctcacattatttggaatgatgtcctcccgaactaaatcaacgcaacaatcctaataaaaccacaatttaaatacagaagctacacatatctcaattttcagagaagcacccaaagtatgacagatgcttcacaattgggcataatttaagcaaaggcgctcaatttagcgcattttgaactctgataaagccaagaaacaccaccaatcatcatatttaccccccaaattacgcatgaatccacagtgaattccccaatcctgactaacccaaacatgtaaaaagaggagcctcttcccttttgtccccaaacatgtaggagccctactcctaaacggccaagatcacgtacatgtggaggccaccttgggcgaggaggagcacgaggcgggccagaggatggccctccagatcacggacaggttggtgacgaacccgacgaggaggaagacgcaggcgaggccgatgacccagggcatgaggaagaaccccagcatgaaggtcaccgacccgcacagcatcagcgccaccgatgcccccagcagcatcgacgctacccccgccgccgtcacctgccgcggccacgccgccgccccccgsccgccccctttcyycggccacgcccggagcaccgttcagcagcagcgcgcacagctcgtacatcgccctcgactggtcagcctccgccgcytccgccgccgccgtcgccgacgacctcataccacccccaagaattcttcaagaatcgaattcaagaaatcaagaaccgatcgcctcctcggcggtggcgcaagaatcttggaggaggcgaattgggtcggagaaattggttgtcgggtcgggtttgcttctcgatcgctctctctctcgcgttggtggaattgaaatggcgagatgggggaggagagacatggggggagatgttgaaatagaggggggaatgggaaattgggaatgggcggagacgtctacgctacgagaggataatggtaggctggatttgtttattcggcagttatttccggtgttggcgtggataactgtgcaactgattggttgcgttggcggtcaaatttgcactagcacttgttgaatcacaacgtttcaagtttatggaaaacacctcaaaatttgtactccatgctcgtaaaggaagtcgtttagaacagcaatacggtcttcaaaacacaactttaactttttgtttctataaaaatatttattcaaaaagtgatatatttatacttttataaaagtatttttcaagaaaaatctatacatataatttttacattttcaaattcaacaacttgagagttattcatgatttatatttctaaggtttgatttaaacattgtcctaaacgacttcctttatgagtacggagggagtacttctttctctgtcccaaaactacttcaaagtttattgtaatattttaagacaaatgaagtatactatcttcgattataaatattttatgtttggagtaagacacggtcggacttttgataaaacgttgacgatcattagtttctaaatcactattttttaaaaaaaatgatatgaaccgatttggcatgaaaaatattattatagtactatgggtttattggatctgcgagtttattataacatgaattgaatgtcgaggtttcagaaatttaaccacctctcttctcttatggtactccctttggtttaaaatttatggatgttttggacagaatatcacgtactactccctcctgtgccaaatgagttgacgttttgaggcttaaaaatattataatagtactatagatttattgaacatgtgaataccactctcctatatatagtgctccctccgattttaaaattattgatgttttgggacagaaatctcacatatcaaggaatgattaattgtgacgcttctctccggtgtcaaattagttaacgtttggacttgggaggcttgaaatatattataatagtactatagatttattgaacctgtgaataccactctcctatatatggtgtccccctccgattttaaaattattgatgttctgggacaaaaatctcacgtattaagaaatgattaattgtgacgctactccctccggtgtcaaattagttaaaggcttgaaatatatttcaatagtactatatatatttattggacatccaaatttattataatgaaattgaatctcaaggttcataaatctaaccacctctcttatatatggtactccctaattattgatgttttggataaaatctcacaatgccaaggaatgattaattgtgatcctactcactcggtgtcaaattagttgaagtttggaggcttgaaaaatattataatagtattgtggatttattggacctgcgaataccactctcctatatatggtgctcacctccagttttaaaattattgagatttttggacaaaaatctcacgtatcaagaaatgattaattgtgacgctactccctccggtgccaaattagttgatgtttggaggcttgaaatatattataatagtactatagatttattggacatgcgaatttattataatatgaaattgaatgtcaaggtttcataaatttaatcacctctcttatatatgtactccctccagtttcaaaactatttgatattttggacagaatctcatataccaaggaatgattaattgtaatgctacacctccgatgtcaatttagttgaagttggaggcttgaaaaaaacattctaatagtactatagatttattggacttgcgaatttattaaaatatgaaattgaatgtcagaaattcaaccacctctcttatggtactccctccggttttaaagttattgatgttttcgacagaatctcacgtaccaaggaatgatttgtgatatgctactctctccggtgtcaaattaattgatattttgaggcttgcaagatattacagcagtataatatagatttatttggacctgcaaaattattatgaatgaaattgaaattgaatgtcaaggcatcataaatttaaccacctctcttatgtatggtactacctcctgtttaaaattattgatttttttttgacataatctcactatcaaggatattatatttgttttttatgggacggaagaagtagatcgcggtttacaaggaaaatgctggcacaggtcttaattaattagtggtatctcctgttctctgcaccctttggtaattttgacgacgcagtgttatgcacaaaaacacgtggtgatatggtgcatgtgcattattatcaaatcgtctctattcttcatttcagagatggcttgctcattcgtgtttcggacagtacgcaactccctccaatttttttttwaaatctagcattataacggatgaagtaacaggaattataagctaatacacagcaaagatctgccgaagtgcattgtttttttttacaaaaaatacttatatattctaagagttaagtgtacgaacgggctataaacttgtgtgcagatatattatctagatctctaaattcttaaaatatattttcaaattatcaaacttgttttggatataatatatgatcaaatgagctttatcctactccatacggtgatgtagcatgtcatggtgacttttacagatcattagtattttttaaaaaaaaaacatgtttttctccttttaggtagagaggacaaaagataaaataaaaaaatattgaaaaaaattaaggtggagaggagaaagctaaggcgagaaaagataaaattaagaaaatactattaacgcatagctaggcatcactttgatatgtcacgtttagtatatcacgtcagctcatgaagtagagtgggttggaattcgtttgaatctatatcgacgtcgcaccgaagacaagttcagaaactcggaaatgtattctgaaggtttaagcatctagctagatgatatacttagggaccgtccttgtctaatataatctaattaatatatgatctaaacgtgcaacgcgagggttggagttgttaccatctcgatctatggtagtgttacagaatgcaagctggagcactgattgcgatcgaggtacgttgtttataatataatgtaccccgatctagcttgattctcttgtccttgttgcaacgtgttacacgcgaggaagtcccattcggtttgagacaacgatgatgagaggagacagtagcagcaggtacgcgaggaaatcgtgggcgacgacgtacgtacgggtgccgccgtgcattaatggctgcgacatattgtactacctccgtcaaaaaaaaaaaaaccgggtttccgtgtccaacgtttcaccgtckgtttaattttaaaaaattatgaaaaaaaaataawaagacaaatmaygcataawgtattaatcatgttttatcatctaacaacaataaaaatactaattataaaaaaaatttcatataagacggacaatcaaacattggacaccgaaacctaaggtttgtctttttttggacagagggagtagtagtagtatcgttctagatagtgctatatattgagcaagtttaatagtatagccaactattagctctagttcatctatagccaatttaatagcttatttatacaatagttatatactacactattaatatatggtcccacatctcatacacacacaatgtattagagtctgtgctgcagctggctacaaatctgaagctcgctttccttctttctctactgcacatgtgcttacaggtgacttgtagcttgctactgtactcgctcttaggttgtacaaatagtcaccacaggattagtttccgggcaatccggggcaacgcaaactgtgaaccgcgctggatgtgtacgtcgttgttgcttgcacatggtgataacatgggcatactttgaactcgggttgcacgtactgagagcatataagtgggtcgatccgtgaatctacttatagcctcaacgtaccgatttggtacaactcgtcaggaacgctacgttcacgccaaccccgcatttcgatcagcttgtagccttgtatcctcgacgtaccgatttggtacaactcgtcaggaacgctactttcatgccaaccctgcatttcgatcagcttgtagccttgtagcctcaacgtaccgatttggtacaactcatcaggaacactacgttcgcggcaaccctgcattttgatcagcttggtgacgaaagcgtgcgtttacgacggttgtgttcggtagtttgagttgggaactaattaattcctctcacatgtaaaagggaataactcattagtttatgattaattaagtattagataattgtttttaaacatagattaatataattttttaaaacatatttttaaaaaaaatacaaggttggcaatttgaaaagcgtgtgtgcataaacgagagaatagagttgagaacttagtgcctcttagatttgcatgaataatgtaggatttttggaaaattctaatcctatggaaaaaaattcttatgaaaggcatttaaataaaggattgtatcctatcatatcattttaaaattccttttgagtctttgtctcttattcaattcctataattttttatgtagttcaatcaaacggttattcttattttttttataatactctattttacaattacatttctactagaatcatattcttttattcctattttttttataattcttatgattcaaggggactttagggggtgtttgggaactagggactaaatttagtctctcgacttatatttttgtgagagggactaaagtttagtcccaatttagcccctccaaccaaacaccaccttagactcccagacacagccgaacttgccaatttgggaaggctgccgtctgtaggaattaactgccgtccaaaaccgcagatcgatgtcagtgtttggtgatggtctcgttgtctgaactctgaactctgaagccgcggccgccggtctcggtctccagacatgtgggttcccgccggagaaagtgcaaactgattctagtgcttgtcgcgaagcgtgccatggcgagcgagctcgtcggagacgacgaggcagccgtcgtcgtcgtcggccgccgcacgcacgcaatcccgttccggcccaactaatgattagccggctgccggcccaatcgacatgggccgtatggcccgagttactgtttgctccatcggcccggcccaagctagcaatcccatatgggcccgagttgcgtccgatctatatatcgtgcggcgaagatcaaagggggttaactgcaaaaatacgcacgggctggccctacgttttgatggcagttttagtgcagatgaagtggatgattcttggattcagatttgtttcatcgagccacctgaagcgatgcacaatccagcttggagatgaagtctatctgttggagttttgcctcgaaatcgcacggggagtaacatcctgattgcactctgttttcaccataaacattggggaaatttgaagcagtgtcttatattttcgaaagatcaatgagaatgcttacggttttaattttttcgcttatgcttatacttatcagtcatgattttttttggcaagaatattaaacaaacggaagatcccttattcttagggcataatatgtagtgtttggttcgaccagtccgatcaaccagccaaacaaaacttcagtttagtaactgcagtattacaatcgatttgtgggaccagcaaaaaagaatcggccaatcactagtctgtccttcatgcatgcatacacaacaaataattttttactcgttccattcgattctaattcgaagttcaatttgtcctctgataaatacgattcgacagctacaaatatacattgttcaatatacattaaaattgatttaatgttcacactgaagatgctcttattcaatattaaaacaattgaccaatgtggtcactatgtttacaaaattaatgaaaacaaacttcccaaatcccaacccttatagtaatgttttgacacatgatgactaagctgttggacgttcgtcaccatgaagtataagaacaacaagtttttagtagttttttttttttggataacccaagtttttagtagtgatggcccttggtgcggccgcaccccatgatggacgccggcagccgcggcagcacgtcgacgccctcctcgaacaccacgcccatgcccatgtacacgtgggcctccaggtggcagtggaacagccacacgcccgggttgctcgccctgaacctcaccgccgtccaccccatcgggtgcagcgccaccgtgttcttcatcacggcgccgcccctcgcgctcgccgcgttcagacccggcccgtccacctccggcacgaacttgccctcgccgtagccgagcacccagaagtcgtgcccgtggaggtgccacgggtgcgtctcgctccgcccgttcggcggcgggatcgccgtgttctgcagcaccacgtcgaccaccgagcccagggcgaggcggtacgcggcgtggcgcacggcgaggctcgccggcggggaggagaggttgaggctcccgtggtcgtagctgtccggcggcggccgctggtcgaactcgccgcggaggccgtgcttcatggcgacgaggtacggcgtcgccgggaagctgagggagacgccgttgatggcccacttggtgtggttgtcgatcttgctctgcgtgttgaggaggaggagaacgcggtcgggcctcgccggcggcggctcgacgtgccccggcagcgcggcgaacgacctgctctgcgccaccctgctcgccgtgtcgttccaccgtggcccggtcggcggcggcgtgcgcgggtgatccacggcggcggaggcgtacctgacgacggccctgcccggcgccgtcttggtggggtcgcggctgacgacgtgcgacgccgcccagtagctccgggacgggtcctggtcggcggtgacgagcacggagtaggtctcgccggagtagatgaagaggttcttgaccaccaccggcgtgacgtagtacccgtcggcctccaccaccgtcatcgtgtgcccctcgatctcgaagctcagcgacgccagcgacgtcaggctgccgatgcggaggcggtacgtcttccccggcgaggcggtgaacagcgtcggccacccgcactcgccgccaaacgcattgcacgccgcgccaccgccattgctggccgccggcggcgagcagttgaacacgcctctgccgttgatcagaagcgactggggctcgccgacgaacaccatggggacggaggcgaggccgacggcttgctcgtacacgctctggtgccaccagtccatgaggaggacggtgtgctcgccgtcgtaggcgaagggctcggcgacgccgtcgggcaccgacacgacgagcatgccgtccagccccgccacgcgctgcatgccgtagtgcgcgtggtacatgtacgttccaggctgaaaccatcacaaaaacacccagaaaatcaatcaaaatttgctcatccaaccatccaagcaaagaactaagcatcgatcgatcattgcacgtactccctccgttttagattataagacgtttgaccaagtttattaaaaaaatagtaataatattttaaaccaagataaatttattataaaatataattaattattaatttcataaaactaatttggtaatgtaaatattactatatttacttataaaattagttaaatttgaagcagttaaaacatcttgtaatctgaaactgagggagtagctgcttaccctgtcaacgacgaatctgtaggtgaaggtctcgccggggaggatggggcactgcgtgacgccggcggtgccgtcagcccacgggctgccaatctgcgacgacacattgccgttagaacaatacccacacggacgaacacatgatcgccggcgagccggcgacggcgagggggatggaacgaagatgaagaatgacctggcggatgccgtgccagtggatggcggtgttctcggtgtcgagcatgttgtggacggtgacgacgagggtgtcgccctgggcggcgcggatggtcggcccgggggactcgccgttgatggtcacggcgagcttcctgaagcagtccggcgacttgtactggtacgtgatgttccacgtgtggtggtgcgtcttcgcctccgcccggcgccgccgccgcggcggcgcacaggcacgccagcacggcgagccgccacgtcctcatcaccgcgcacaaagctgacgatcgagctcaaggattgggattttgcgacggatcagaggcttggaaatgatcggtttcgtgagcaatcggcgaggtgtgtgtgtgtgcgcgctttgtgctttgcactgctctgcctcgaggcatcgagtggatttatatagtttacgcgcgtcaaagtgggtgtgattttgcgcgcgcgttcataactgggggctggggctttactaccaggtcaagcatgaagcagctacagagctcaggttgaagcgttcgacggtgggccgggccgtggctcgtgtgygcgygtkggggcatggtacttcgtcagatcataagcgtgtgcgtggctgtgttcgctagtttcgtttcagttgggaacatctcccatgaaaacggagcggtacataagcgcgtgactaattaagtattggtaatttttttaaaaaaatggattaatttgtttttaaaaataactttcatatataatttttttaaaagaaaaacacactatttagcattttgaaaagcgtgcgcgcgaaaaacgggagagggggagttgggaacatgagggaaagaacacagtcaagtgggagtatctgatatttagcataagattttatcaagatcttgaaacattgactatcaatagtttgtcaattaatagtttgtcaataaacgttggcatacgtttaaaattaaacagaatattaagtactagtagttttataaactttaggctccacttgaatcactggaatgaaaaaaacggagaaataaaaaaaacacatgtttctaataagaatataagtgcaaaacaaaggactaccgaacgtagaaaaaacacagaaataaccatttgattagaccgcaggaaatacaagaatcgaatgagagagatataatcgaagaaagttttcaagaggttggagctcttgctaaatttcctccaaaatcattatttactccataggatttttgaaggataggatataattcaatcatttgtttcaaagaaattttcctacaagattaattttttaaaaaatttctctgttttatatctaaattaaatgggcccttattctattagacagatgaagttagagtgagtatatcgtgtcctaatgaacattaattagtagtaatcctatatatttctttatacttatatacgttgctcacttagtgcaattcataaatactatttctcttttttcttataaagccacattactttaatactagtttctaatacttatatgattaattaatgatcttaattgtgttcctctttttacaaaagatacatcgtctcaattatttgtagacttagcatggtcaacctatggatcatattgtctcttgtctcttataaacaacatcatctggatcaactattctaccgttcttaataatagatcaaagatgcatattccgtaacaacgcgtagtatctagcatttccatatactaattcgcggtgatgatttccatgacaaaatatcatgtttatttcgaggagtgtggtcaacgaagcgtagctctactagggtttcataaatgctacttcccctccgtcaaaatatattaactttacaatttatcttaaatagagcgtttacctactcacttatctcaatcaaatatagccatttctcatttaaatctacgtatagaagctcaaaagtgctttatattttttggacaggaagaaaagatagtactacttagggcacccacaatggttatctataaactctctacaagagatccatgtcagcatattttcctacttggaagagatgaaaaaagagagcaaagctatctactaatgtgaagatagtctatagagaaaaacgaggcaatatattagagagctatagatacccaagtagacatactattaaggtggtttactattaatctagtctattgctgagatgtacatgttttacagagagcaccttactttactattgcgggtgctcttatgttttatattataaatcgttttgacttttttcctagtcaaactttttttttacgtttgactagatttgtagaaaaatataatagtatttttaccacaaaacaaacatattatcaaaatatattcaaatgctagatttaatgaaactaatttgacgtttaaaatgttacttttcttctataaaacctagtcaaatttaacaatgtttgacttagaaaaagtcgaagcgaattataatatgaaatgaagggactagtactttgtatgttttaaattacttgtcgttctaccatttaaaagttatgccaaaacacttgtcattctcatattccaaatcactttttaaatgcttttttcttcttacctttctctaacacaaccatgctagtagtagtctcttataaggaattctaattcttactttgaaaacatgattaatatgtaattaagaagaattgcaatgtaatttgctatgacttcgtacgattttctggaacgacaagtccaaattaaaacataaaacggaggaagtataaatatatatacacgcttcgttatgcaaactagtactaataagcaaactaccattaatgcatttggcgtttgaattaatactacgagttgtacccgttgtctatcagtggagattgtctacagtagcagccactgacatgtaggatcgggttcacctatcagccactgctactgcaaatgtagtactgcgaagatccatgtccgttgtctatgcgtgtcgtgcctgctctgctcttaaattggtaaaaagtattggttagggctgaatgcaaaatgcatgtactcctggtcctggacgcatgcttaacgaagacgagatccagtcgaagccctctttaaaaccaatgtaccatatatgggcvtaaaaagcaaatcactcaagttgaaatgcctgcatctacattttcgctcgtacgttcgcaatcacagtttcgggtcaactaactatctgcgactcggacaagtacgactgcttgacagcccaactacctgggctacttgcatgtttcttttccttaattttcatgcagaccagcatgctcaatttatgtacaacgacagctatttttttagacaatgatgtacaacaactaatcagttaacctaatactcctatatataaagaacctagaatgcacatgagcatggtaattaaacctcgacattttattatatttgacacactggatatatagtcaataaactttaccgcaaattatgaaatgtacaggcactgcactgtaccatacgtagtttttgtgcagcatataaccataggctgtcacgtacggccttttataccacatactagtccttgaacgcttaataataattaaaagtgcgtgcatcacatcagaaaagtttcaacacgctagcacacaaacacggaattactagtctcactcttgtaggagaagatcaatctaatggtgcgacttgatctgtgtcgtcacatccgtttttattggttgtcgcatcggccttcaggagttcagggtagccatgtcggcatgaaggcagtcacgcatgagttgttcatctgctctggagtaaacctacgaagagaatcaaattgtgttaagggtgtgtttagttcacgccaaaattagaagtttggttgaaattggaacgatgtgacagaaaagttgaaagtttatatgtgtagaaaagttttaatgtgatagaaaagttgaaagtttgaagaaaaattttggaactaaactcggcccaagttcatgtgtagagagcattccatacctttttttagcacagaataaaatagatacgcacgattgagtggacctccttagtaatctagtaaggctagaaaaacaccattcatatctcttaagcatgtgttaaaaaagcttactcacggatgtatgcgtgagtgggtgtacgcgcgtgtgtagtggtatatatgtgtacgtgcaagcttttcccgtaataatgaaaaaattaaactggatacacaattggtttcaagaactaatgagatcagagaaacgatcatgaagctgaaatgagtaacatgcattttatacccgatctgcaaggtgggctcggcggcagcttccagggaatggaagaatccgttgccaccgtgcggtggcacctgctggacggcatgaggcgactgccgctcgtagccgagtagggtggcgccgtgctcccacacttgtccatgcaactggttgctctcctccagcttttcctcgcaaacgaatcaaacattagtagtgctcgttattcttttctcacttgtgtttttttttttcatttcacagcatcattttggttatttcacagagctacgtaagcaggcgttagccaggagatatatatatatccgaggaagagatgccaggaaaacggacctaaatgcctaaatcgcaaccgaaaacagtgtgacctcgtcttgatcaattgttaatatgcattgcttacgtgtgagagatccttatgttaattaatatgcgcagttgaagtaatatgctgtctacgaagcttcatgtacgtattcgttatgtagaaataaccaataccaaatgttcttttgtaatatatacaattcatcctacaaactaatatgcatcaacgtacacaaacttgtccagtttctgttatacgcccttacaaaccatattttatatgttcacatgtttgtaagtttatgtggaaggaatatataaagtgctaactaaacactgatgttaacatctacacattgaattcctgatcagattaaatttagtactacatggatgcggggctttgattttgaacaagcacacataaaagtgaagtgtataaattacttttaaaaccacatacttagttcatgcagaatcttaagatcaagtaaatgcatgaaacttaaacgggacaaggaattaaacttacttttcttctgaggcacttatttgcttcacacaacatttgttcctgaaaatgatttaggtatataaagttagttttggaaataataaattttcttgcctgaaatacatagttggtaagttttatgtcaagcttgtaccctcctctggagatcagtgagctgatcaagcatatgctgtgtctgcaacaagattagagttaaatttttttcaacatttctgaaacatatgtgagaaacagttaacaaattacccttgtggatctaatgtgcctcaaggatgaatcaagttgtttctcaagctgctctagctcttttatgccaagtgtcccaagatcttcaccaagaagattcctgtaattgtcaacagaaagatctactaagttaggctgtatttagttccacactaaaattgaaagtttgaagaaattggaacgatgtgaacaaaaaagttggaagtttgtgtgtgtaggaaaattcgatgtgacgaaaaagttaaaagtttgaaaaaaaagttggaatctaaacggggccttagttctgtatattttacactgtgattgatgcatgcatctaattctctaagcaacttcagtatatactactgcacgcatctaattctctaagctagttctccctgagattactgttttaccacttgtaaaccctatataatagagacggcggtaggaccttcattgggttcacatatattacttcactcttgttaacactagtcatatgtggttttttccatgcaatatagttttgtttttcacccaaatggccaaaaagtatctagtgtacacataattgttcttgccccaatacacaataatttatctactttgcatatatatgaatgaaaccaattaactgtgctccatttcgtctttgataaaattgaactcataagtggaagcctgatattacctttgggtcctctgtaaattttccacccgtgccttcagtttgaggtactcattgcggctgctttgcactaactgaaaaataaatttaacttcagtacaaagaaataggaaacaatttagagattctatgtgaaaacaaaataatataatttcacatgcaaaattaggcttatgaatgaacaatttattagaaaacagtgatattaattcatgaatccatctatcatatcatggtcaataaccagtgactaggagcttttctgttttatattcagatctacatactagacatttcagctagcacaaattagagttgtaaatcagtgttattacatgtggaaacacaacaacaatactcattctagttatagcactctttcatatgcaaccttttgcagtgctctcatttttcattaaattttgagtcttgtagcaacatcacatacattaagaagcacagcgaatatattaaattaagacttcatttttaattgtactattcaacacgtgtatatagttggtaattaatgataatactaaaagcagcatatctaggatcaatcaattaaactgcatgaatcgaattgttgaagtattatccagtgagacacagatcgattaatcagaacacaaagctagtctatgcatcaacttaaatccataaaagcttgtcataactcactaaaaattaaaatatattaatagaatctagtaacctcattttccttgttctgtattgcagtatctggcccaccataactgaatttttggtatctttccaaagttctggtcatgctgcaagtttcaaaaacacaaatggctatgtttatggaaaaacgaaataaaggaacatatatagttcgcccataactaaatactaacaatctagggcacattcttttccggggaccacatcgattaattagtagatgaaaaatcttgtttctcacaaaacatgaacattagctccatgacacggatgaaggtgcttgcataattggagacaatttctaagaaccataacgttttatcttaattcttgcatcggtagtttcaagttgatttataattttatatatgtccatgatatcaacctagaggccactttttgtaaagaaaatggagtacactctttaaagagagatatcaagttcagacgacacacaatgaaatggcataacttcacgcagactactactacagctataatgctcacccccccccctctaccgcgtcaatttagtgaccttttggctgtgtttagttcaacgcaaagtttagattttggttgaaattggagatgatatgactaaaatgttgtgtgtatatgacaggttgatgtaatggaaaaggactgaagtttggatccaaacacagcctttgtttaaacaagtcgtgaattcagatttctgaaaaggatctacagtacacgttgagtatcaatttgtcggcataaaatactccactgaactagctctagctagaactagaagagacatctgatgaagaccaatcttctgtactgacagctcagctacgagagctgaggagaccaatcgaatgacaatcgaaagctgtcactaactgtaccctgcagatactcaagtgagtcctaggaatattgtgtactcccttgcaggatttcttccgaggagcagaggagggatgtttcactcaccccatatccaaattgaattccctggtcaatgaaatcatgtactcttatttgtgaatatatttaatgttagaattttataggcgtattaattttaatttagtaacttaggtataatggaaaccatttaaacataactataaaaattggcaagcatgtactccctccataaaaaaagaaaaagaatgctaaagtccccatatacttacggctgattataagccataacggcttattagcaaccaaaatataatttgtgagtaaaattgtatatgtgtctttagcgaattaaaagttaatgctgaaaaacaatctacattgacaaaacattaaaaatcaacttctaaatcaagtttcgaaattcaaaatttgatattggcttataattcatagggtaaaagatgaggccctaacttctagctataaatctggacatagcctatatatgtccaggtttggcaaaaaagttggttttttctgcaacggagcatataataatgtaatcattatctaaaatatataatgatgtaatattcactatagaagatattattaaaatgatcagtgcaatacaatgagcaagaaaatttaaccttctaaagtttggaaaatgtatgattcaaatatgaaatgaagctcatgaatgcctgacttatctaccctaactaattgtttatctctaaacacaataccaaatgttttcttccccccgaaaaaaaatgttttctaattcaaaatcaattcaactagcttatatgcggcttgtgaattatgcctagccaatcagacgctctgtgtttctgaaagacaattatatatatagtagtatatgatttttcatatacttatctcaggagaaacagactttatatttattgatgttgcctttaatgatgcaaccataactcacttgaaaaacaatactccccsgcggccatcccttaaaaaaacaaagagacaaaatcttaagtgaaacccccaaatcttgtaaggtatgctgcctccaaaccgtggaattcatgcagtgaacgtttgtttagacacacatccggtacatggctaatgatatgcatgatcccttcacacaccccccccccccaaaaaaaaaaattttttt

SEQ ID NO: 505 - DNA, 15439 bp, Oryza sativa
  misc_feature (1)..(15439): CL004886.208 (OsMADS13)
  misc_feature (1)..(15439): k is g or t
  misc_feature (1)..(15439): m is a or c
  misc_feature (1)..(15439): r is a or g
  misc_feature (1)..(15439): s is c or t
  misc_feature (1)..(15439): w is a or t
  misc_feature (1)..(15439): y is c or t
taatggtaamagytcagtacgggtattcctttgcgccggtatatagtcctaagttaattccctggggagggtattcctccgtatttagccccggttgtatggtcatgacgggctatcataaggaactcaacagttaagggtggcttctcgaagtaccaggagggcatcggatagagggtattagctagtatatcagttaactagaatgtatatatgtgacggagcgtggggctcctcaccgggagaccgcgcaagcccccctttgccggttcggccgggggccctggttgagattctaagcttctagtctgtggaaagtttgcgagaatggaaaaagcacaagacacgggcgatgtatacaggttcgggccgctgagaagcgtaataccctactcctgtgttctagtggatctgtgtatgaagaagctacaaagagctggagagccagagagctcttattctaaaaaccctcttctcctttttttttctctcstgggatctcctctccagatcctccccccttccagcctcccctcttaagtgggcaaggtcctccttttatatctcaaggggataccacatgcaccacttctccctctctccttttttgggtgggggcccatcctatctatagtaaaacttggcttgccttcttttggaagctgaaacactgcctgtttttgagtgtggccacgcgtcctcgttcgtctgacctcggggatcaccctgtcatctcttcataaatgggcggagatttgyaacggctgctgcccgagtgacccttctgatgggacggcccatacctacctccactccgccggaagcaggtgcaacgtgggaacacggttgtcttccggcgacataaccagtgtcagaccagtcacagaccggwcacctttgtccaccacrtgtcagtttagcaatctgcatgttcgcccttcttcatacaacgtcttgcttataaaggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccccccccgggggttwgccacgtgggtgatcgtgtckscyyctagtctctaagtcatgatactcccggtcccatgtcaccgacagtatgtatactatgtatattagaagtataagaatatattttctttatcttttctttccacatagcttagatgatatattatgagaatgagtagttaatgcttgtgtgtcactctacccttggattattttaacccctgcttagaatatgattatcataagtaaaataaattattactcaagttctctctgtatgatcttcccaggggataaaataaatacgatacacttggaatactctcgggtgaaatgctacaatggtatatccgtgcgcttgcagatgaactctgtaaccataatataccagaagtatttatgcgccattgctgggaattatatttttagtaatgtcgttaagaaataccaacatccactcgtgcaaaatgtaaaatcaaggagctaatttagattttgtgatgaaaatattggttgtttgttgatgatattttggagtttaatagacggttgattttgtgaatttggtgttttcggctgaccctagcggtcagaccgactgggtgccgccggtcagaccgcaggtgttgcggttgtcagaccgactgacccgatggtctgaccgtaggggtgaaaacagtcacggaaattcccaatcaaccgagcgctgcttccgtataaggggtaccgtttctgaccgtaccctttttggctatttttagattttgttttttctaattttttttcatcgtattaatgtcgacagtaagtagtttaaatgataaatatggtcaattatgtatgcaagaatcatttatgtatgcttagtcatgcttaattaccactagctcacataatgggataattacattatttacacttagcatcttgatgagctgtgagctcgagacatctggccatgttttttttgtcataattatccaactaaaatgtggcttaatggtgggctatgggtgcatggttttgctagtcgcacccatggcaattaaggatcggttcgcgggaaaccctcgaagaactaccgtgcttaccacaagctagcgtgggcaacggctaggcttgtagtgtaaatttccaggcaagggcgagcgtgatggagtttggatgggccctgtgacggcctatacggctgccggattcacctaggcacaagaaagggttgcccgctgcctgctgaggagtgggggcgaaatctgaggtgtggtacacttggttaaagggggttatgcgaagggtcttatcacagtctctttccggtgtatcctgctgacatgtcggcgcacggaaacatgtcgtggggctatgtcttgtaggtacaattgtacacctttgatcaaagtaaaattattcgaatagccgtgtccgcggttatgggcaatcaactagcttcaccgtgattagtcccactctattaattaacttgacataatgaactgatgtggttcaggtggtttggttggcatgttcaacgtggtgtagccttgttcagtggatatataatcttgtcttaattaaccaattgttttactgtttccagctacaaaatatttacaaaccgcctttataaaaccgtccttgactcccattgcacgtctacatcattggtgcgacttgttgagtacggtggttgtactcaaccttgctattattctcccttttcagaagtgtagtgcttctgagctgaagacgaagttagaggaccaaggcttatacctcagttgagtttttgatgtggggtggagctgaagccccgctaggatcgtatttttcggttgctgctgctttcttttcggtgtgaggactaagtgccttgtctgtaaataatttacgctttattttcgtttgtatatgtatattaatttgtcgttttgtgtaccctgacttgattcccggatagagatttaatacacaaaatagtctgaaaattttgggctaaatttctgggcgtgacagatactttagaaaatatctctatgctttctagcacattcatataggaattttttatgtctataagggagtataggcattttctaaaggcattaacctaccagaaccatatcaaaccaatgtaaaaaaataataaaaaaaacaatatcactttccttgcaactgccaatctttgaactcaaggcatcttgaatataccatttttaactagaatggtcttaccatctcaacctcatgttacactcttacatatgagcccaatgttacttttatctagttaatcagcttagattaaaatttctataagtgtctctatagagattgaaattttaaagtgccaaaagagtgtctctgcaagataaatttaataaatctctactacttaaaaaatctgtagtggtggtcttgattcctgacatagcagacgcatctaacaaacacgtctaatctcaaccatccgattttcatatccaatggcgtcaaatctcctcccatcgctcctctcctcatcacgcgccacgcccactcctttccccacgccgcgtccttcgccctcctccctgcgtcgcctcctcgtggtcttgaatccaacagatcagatcacaattcaatcttccgcacgcgccccacgcatcgtygatcgcacgcggcgcgcacacacacccctttcccccgattttctctccctctcaacgccgtctcccatctctgtttccttcgcgtccgcctcctccgccccgcaccaaatcttcgcctcctcttctcccgcctcgccgcgcatgcgctgagtgagcaggctggcagcytgatgaaggcacactwacgacccmaatctccggctcgtcgaccgscctccacgcacgccccgcccccgatctccgccgcctcttctcccgcctcgaccgccttcacgcgcgccgccggaagccaatctcctcggcgccaccccattctgtgagtagtccgcctcctccgtccggccccctgtctccgcagcctcttctcccgccttgcaggtgccctccaactcaagagggctgagggcgagcacggtggcgcatggcgactgagggtgagtgcagctgacgacgccacatgacgaacccaaccggctgcatgttatcttccccccaaaccctaaaatttccccatctctttctacaaatccatctacatgttttcagatcggggattttgtccttttaggcgtgttaaatttcaaacatgggaattagagatcggggattttgtctttgcctgccatgtttgtacaaattatgctaartggacagcatgagaacactaggacagctgcttgtgtcagagactgaatgacactgttgcataacactgttgctggatctcctctctcttgagacagggttatctttaaatcagtgcaagtacgtactgtgttctcaacaagaattgaaaacccaaatatggatttagttgggcatgatgtgtccattaaggtaagcgatcacccacataacccccacaaataatagcttcagaacaagtagattgttacatctgaagaaatatcatatcactcctgggcatatattccatatggacaatatgatcgaacttgtgaagcatcagacatgcagaattaatttttttccccttattttcttgattttgctgcaattataagtaagcattgttagtatgatcccatggcgtgtaatagcagttctgaactgatagatacctgcaccctcaagaaaatggtttctaccgtcagagtaacaggtcagggtcatgctaattaatactccttctcaaatgaatttttatctcaaacagtctcaattcaaaaaaaaatcagttcatcagtttgtcaaaaattgtcgctggatggatcggttttagcattaatattgaagcaaataaatgcataggtgaattagatttttttttctctataaggatattttgtgccacttgctttggttgtcggttagttcatccatgaactcggtagggaacttgtctaagcaaccaatggtcaattttctcatgaagcagtctttttttcttaccagttaaaatgtttccagctacaacaaatactcaggtttcatttcattgctcaatttcagatcatttgtcgaggttggaattgctgcgggatcaagcgaagcctcgtcaggccatgccctcgtctcattcctcagtttatagagtccattccaagcaggtacaatatacatcctcggaacaaataaatgtatttggttttataagaaaaattagtttgcagtgcatcagtgatcctatattcctgcttattggagtacatacatatatgattattggcgttcatctgtgatcagttccctaggtttagatccattgtgttatttagaattagaatggtcatttattcagggggctttgacctgttagtaacccgagtcaagtcatggcctaattaactgaatgaatgatttcagactcaagaaaattgaaaataatctacgcatcttatcttatgaaaatagtatgggaaagagcacaggaaaataatctatctgaactataccagtttgtagcgtgggaatatgttatactcagttttgagggtgtaccacggtaactaatgattcacagctgctttcctccagggtgaaccctcactttgctggttggctttcagccgtggattagcaactggttcatgttctgaaatttttatactaaccatcctcagtctgtagtatttgaaatcaatctttcagtttgttctgaaatttttatactaaccatcctcagtctgtagtatttgaaatcaatctttcagtttgttctgaaattttatgcagaatataaccaatgccagtattttggaatgagcgcagaattgatccgtcacttctgaagaaactccgttacttagcagaagcagaggccacaacctggcagcggctggtcacttcagcggtctccaattgcctttgaatacgccaatggtaatttcaaaaatctccaagtagtccactaattttattacttacattttttttcatctaaagcaaaattgaaaacatatgtttccttgtaattctaaatttgactgcacatattttgatttttgatgagtactgctcgatagattcaaaacggccatgagttttttttttgagttgaagtggcaagagcattgccgaatatattagacgaatagagttcaccctgtttataaggaaaaccgggcccaaaaaacatacaactgcccggtttgctaaagtgaaaccggcgaaaaccttacacagaagacacaaaaagcctgagacaagacaactacgaactgtcggaggccgagggatgagcaagaccgtaagatgaaatctccaaggaggtgaataacgacataagccgctgtcgacgtccgtccaaaaactgggctggttttcacccaggggggagggagtccacaaggcaacacctccagggaggaaacggcacccgtgggcgtcgatattgccaatcctagaacaggcagggcatgaggtttttgggaactagcaattattgattttgattgttgatgatgaagagttctgactatctacatgggttagtttcttgttcaacaaattcaggaaatagtttcagctcatcagaagtttgcatcgatgtcatcccttctagccatcttctgtgcatttgcttggaacatttggttctgcactaccgttgactataaaatacagctcaacagagctttattttctcacatttctcataacaagttggatatggaaaaccatcractctgaataggagatagcgagctttggaatgattctgagatagctccattttttatcttgtctgaactttggctgtgagctcaaatgattaaatcagtatctttttcatttttttcagccactgaatactttttaatagttttctattattctatggataatgcttgtgtgcatgcttatgatggattgctaattgttttacacgtgcataataactgtaattaactgggggagtgcttcttgaggtagatggaaagctttgctacttttgaagaaaacgagtggataatagagaaattgggtgagacatcatttattctgcgcaactttgagaactggctgagatgtaaacctgggaaatatagtcatcccgtgtgartaacacaaatgagcttcgaaggacaaacatcatgccattgggtcagttctgcagttaaagatagttgtctgaaattgatgaagttcttgactgcaggttgtcttttaagcagtttgtagcttaataaacggttgtgcaggtgccatggtcatactattgatcctgttagaacaaacaagataaaatggatgtgcccaacaactagacaataccacataacttatgatattaccgatagtgatgcgaaaatcagggaatagacagtattgtttcttcttgattcagaaggcgttctccagctttcagcaagcctcatcttctattgattttggcatgattgagcgaacgaagttaacctcgctaaatgaaggtacccaccgctatagactgtaatgatactccctccgtacttataaaggaagtcgtttaggacaatgtttaagtcaaactttaggaatataaatcataaataactcttaagttgttgaatttgaaaataaaaaaattatatgaatagatttgtcttggaaaatactttcataaaagtgtgtgtgtgtgtgtgtgtgtgtatatatatatatatatatatcacttttcaataaatatttttatagaaacaagaagtcaaagttrtgttttggagaccgtgtcactgtcctaaacgacttcctttgcgagtatggagggaatacacattagttactaaattttcagaggcttttgccttaactttgttcaaaatataatggagaactctgttaacaggactcgtaatggggtaatgttgacgtcactcaatgaagctacatgggtcttgcataaagggattgatcagcttttcttttatgcttgctcattgatgaaatgacaggcattaggcctttttattttcaaacatttaatttgctaacattgatgccgtgtacccttagtagtattattatatagtagaacattatttatatcatgttctttggggacaaatttacaccgagtgattatttcacctggtgtgatttgaaattgaggcatattctttttcccgttgcaacgcacgggcacccaactagtcaacaaaagaattattcaatatatatagagaatgcaaattatcacacattagagctcatttagaatgctggaattttacaataatttcacaagaaaagtttaattcccacaaaatacttgcaattgatccccctttcttttcgcgaacgcaccaaaggattgcacgtcagtatattagaaaaaagcagagtttttgttacacaacgtaaccagtcagacgaccattgcatgtggataagggaacaragaamgaaaccaaaagactgctaaagtwaaaaactaccaaaaaaatgttgctcctaaatagatggarggtkgtggcgaagctccactacactcctaataaacccctaaaaacagcgacgccagcagaagaccacaaacggtcttcctgtaggatgactttcagaacccttgagagtgaggaaagagagtaatcaaaaaccctggagtttcgccccttccacaactgccagagaccaggagaattagagagtcgaaacccacacgaagatgctcaggtcgacatgccctagaagtcagccaccagagtcatatwtaagccacggaagcatacgcgcggttacactttcaaaaaagtttagtggcacattacaatttattkggtgtattgccttgtgttaaaggggcacacttgtggatgtacgtgcagtgtgcatggtggttatgtgcatgggccatcgtgtaattgcgaaaaaagtcatataaacctgcattgtacacacaaaatggtgcacatatgtacaaaatgaatccccaaaggtgacacaattaagcatgcatgcatgcacgtaaaacataagtcaaatatatatgttttacttagtttaatttgatcccaaatgaagaaaaatactcatcactcatcagtacacacttctgatagatttagcttcttaattgggcacagctaactagctagctctgcccatttggtctctccaattctccatgagataattaagtagcaatttataagggattaacaaaatgcagcagcacacaaatactatatatatagccacatcagtagtgtctgtctgcataacagcataagatatagaagatgagctgatcatcatatccatggcagcaggccggtgcagaatgaagttcatgaggttcagaagtgaggaggcggcgcgtcggcggcggcggcgccgggaatggcaaggtggtggtggtagccgaggttgagctcggtggggatgatctgctggcgctgcgccgccacggcctgcacctgcgccgccgcctcgaacaggttcaacgggaagaagcacttcatgtccagctgcgccgccgccaccgcgaacggattctgctgctgctgctgcgccgccgccgcagcctgcagctccatggcggccgaccgggccaccgtcacctgctgcagctgctgctcctcctcagcaatctgcaagtgtgcacatgatctctcatcaacgtatagtagagatagatgtgtcgttgatgtagagatatattgttcttttcgtcaagctttatagattaattagctagctatttgttcaaattaatttaaacaaatagctagctaattaatctctgatttgcaaacaagaaattggaagttggttctgatttcttgcagtcacctgatatgtatttaccttggttctgaggtccatgttgtcgttctgaagctcaatctcctgaaatcatgacaagaacattgcaaatgagtaatgctaacaagaattatgcaatcaggtaaaaagaatagaggattaagaaaggagtttgcaatcattgatcagtatgtacaattgtatgtaagatgcaattctagtaacacacatacccttttggccatgtaattgatctctgaagccagcagttcattctgagataaaattaaacaaataaggattaacagttaatttgtacatttttaaggccacttagtaagttaacattgcatcagaaactgaagaattgttcaaacaaagtaaatcaaggtgatcatatatatctaacagcactgagattttgttctaaaggtgacaccatgaggttggtaattgaatgttcatgtgaaaatggtattttatatatagttgtttaccttcctggctctgatctttgaaatgcctttctccaggcggctttcaagttgcttcagctccttcagtgacaggttgctcacattatcgccaaccaggtgcctttcacataggaaaacaaaccaaacgaaaataggtatttccaggtcatcacattgattctgtaaagtaatctcttttcaatattatcatcgatatatacacatgtgtttcttgaatggcagatataaaaattgtgtattagtattaggcacttacttgttggtgttttgcagcatctgaatctggtggcgcagtttggcagactcctgctggtagtattgcttcagacaagacaattaacaagacgatcgatcagatttaattacgtttatcatgtagctctaattgatcagcaaaaaaaaaaagtaacagtaaccttaattgtagtgcaacagaatgactgcattcatgcttttacattgaagtttattttgtgaattttgtttgttctcttcagtcactaactttaaattgcaagccactagccacaaaagggtacacttacagtttctaagaaaagtatactcttaaactcagagaaagacaaatatatggagaacttcagtgcagaattgcagactaggcattaggcaatctccaagtggttcacatactacattaattatgaattcaatcttgtcgtaaagattgatgctgtatagctataacacatgaatgtatataagcacaaagatcaagccataccctgatgaaactaacaaattaatataatgcagcagtcaattacctaccacaaaaagtatataaaatacttaaaatgcaaggcatctatatgctctcactttatatgtatgaatatgccttggttttagaatagtcaccaaattaatttaactgaaactaaggcaaaatgaatagaagaaggtaattaacaaagcagcaacatatatatgggttacctgagcattgacctctatgagaggtgcaccagaagttgagccacaagcatgcgccttcttgtacctgtcaattgtagccttcacactgcagtatatatcccatcagtcgagtggtactctctcaacactacaacataaatactgataattgtgcatgcatggtaatgtagtgtgttcatatatgccaacaagagaagaaatgcaacacacatgactatacatgtcatgaatgcagaaataatgcatgtgaggagcaagcgtttaattacttcagcataaaattgtgcagaagaaaggtagccattggaatgcatgctgtctctagctgcaagaactgtgttgaagtgaacacaagaacggaatgaaatgagtatacacgagctagagagaaagagagatggtcagatggatggccattggcttattaactgatgcacaactttgcaccggagaagagcaaacacagcgaatatgggaggacgttgctgcagtttctagcttggtgcaagttcttctcatgcatgtccatggtgtctatatgtgtatcggtgtatggagaagcaaggaaaaggaaactcttgacagctagtttctagggtgaactatctactgaacatacaacattgacaggagactgagcttccttgctgtgcatgatatgatgtgtgttgtgtgaactgtggagaataaaatatgataaaagatggcagtggctttgctagctgctcaagtactgatagcactgatatatattatttaaaagtttgcatgcatgcatactcatgtacatgtactcgagagagattgcaaatgaatttgacatgtataaaaacaatgagactttgcaaactttaaataattatttgactgcatgcatgaatgaattggaaggggattctaatgtatctttcaaatagcctccccttaatatgtgtgtacatatctaattcacacatctcactttgaaaatgatgagcaatagctaaggaattttccatggaggttaagagagtaactttatttagatacaaaaacaatataatcatgcatgcatgacaaatcaccatatatagtaccatgcatatagtttgaaataaatcttacaattttatttcgtaatctgagtagatgataactgaaaaaagtaagcaagtcttgttacatgcacagatgaaattaaagtccatgcatacatggttaattctttccagcaaaatcaatttagcaagcaggatatataaatggactttagtaaagccttctgaccataagactaagaaaattagaacagaatagtcctttttcaagtaactaaacaggacaacattttcagcattaatcttacagctagctgatgagcaaacatatacatcttgatgagtttttatgataaactctaacatttttcctaaatcatttcacaccttgagttaagtaattcacatatcatctaagaatgtgtataatattaaactcattctaaaatatttaccaagagtcagttttaaccacaactaaacttttactcaataacaaactattagccacaaataaagcaacacaacaagcacgctgagcatgaaatgacacgaagggaaacaaagcaatcagcaagttagtttcaagaactgagtacgaaattaagccaatatatttacagcaagtacatacttgttgttgttggagtactcgtagaggcggccacggctggagaagacgatgagagccacctcggcatcgcagaggacggagagctcatacgccttcttgagaagtccgttgcggcgcttgcagaaggtcacctggcggcttgtcgtgttctcgatcctcttgatctcaatcctgcccctccccatgtcttcttgctctcaactgatcaacaaaaaaggagaccagagatcagatcaaagaacagcaaaaacattgcatgagaagtttgatagatgcagaagagagagtactgatgaaagatctggtaatgattaaagaacagcacaaactctcagctgattaaaaaagagagagagaccggattaaagaaacaactaaaacttgcatgagaaattgatagatgcagaaaagagactgatgaaagatctagtagtgatttacagtactacatcacacgctgatcgatctaagaaattaatgaattcaactatactgagagatctgagatcgtgattcacatagtatgtgtataaagtgatcgatctaacaaattcaagcatgttttatacatgtaaatccaaaaggaataagaaaccagctatagctaaagaggggtaaaacaagagaaaaaagctgaactttgaaagaaaaagatgatttttgctcataaaaaagaaagaaaaagatgatgaaagacttggcggatatggatcaaatttggagactgggacaatatctatcccatcatttgacataagcaaagctcaatcatcgcctatttagaaaggagcctagatgcaagtatagagtgatcgagtaaacaagatctagcaaaagtagtctcaagaaacaaaactttcagatgtgcagagattgctcgaaataatgaagggaagaagcgaaaaagaaagctcaaagaaccagatgggtagatgaatcaagaaggataagatgcaagaacagcacgtctccacaaaaaggaaaaaaaagaaccaaccaaatctgaagaatcatgtttaagaaagcatggaaaagctagcaatttcgatttgcttaactaactatcttaacatatctagctaagaattgaccaaagaaaactcatcacaaagtgagaagcaagaggtcggccgcaggaaactagcttcttccttttctcctgtctcctcacaagatcaaagatctgcctaaggcaagaagagaaatttcaagaaagaacgaaaaaactgaaaccttccaaaagaaaccaggatcactgggccggaaagaatccttgctacataaatagagaaagaagctaggaagaatttccaatctgaacaaagaagcatcaaactggaagccaagcatcacagtttctctttgcaagaactcgaagcacaggaaaagggtttcttttcctcaaagagagaacatacaaacttgaatctaaactgcagctgaatcagtgccttaacaaagaactctacacacacccagataactaaaacacattagcacgcaaagagatatataacctagctaaaattggtcctgaagctgatctgatctttctttctctaccttcgtttcttggagtaggaaaggagagctccagttggtgggttttctgctgctgtgtgaggtgcagaggattaataggagaaggcaaagggaaagcaggaaagagaggaagaagggctagctagctagcttagctgcaaaggccactggccttctttgctatcttgcttacccatttatagctatttagacatctttacatgtatattctttaagcaagaatttataacctctccttttttctatcttgtgtaatttgtgcctagaaacactgatctgcagagaggtatttagttgtttgtactttgtaggcactgctaaagtatgtttagagattggtcgatgtccagaaggctggagttataagcaacctagcaagttatgaaaaaaataagcaactgatcatcccttgttatgtgtttagtacatctgcagaataactgaagtcaacttgccggttaattatcatatatgcatgcctagctagttcttgcaaatgtgtgtgcttaattttggaa

SEQ ID NO: 506 - DNA, 4618 bp, Oryza sativa
  misc_feature (1)..(4618): AB003322 5'-regulatory sequence engineered
  misc_feature (1)..(2183): 5'-nontranscribed sequence
  misc_feature (2184)..(2457): 5'-untranslated sequence
  misc_feature (2458)..(4604): Intron
  misc_feature (4605)..(4618): Exon
cgttgcccagcgaggagcatgcgtaaaatccgcccaagctggtgcttgttgttgccgcgacccatgacggcatccgattctagtattacatgcttgccggcgttatcgagcacacaacgatgttccccgtcgacaccctcaagatgaacatgcaggtcggtgccccaccctgttactcggtcctgtcattggaggccgccttgtctggctaagtagtggacacatgttagccaacatgaacaatagatgacaatatggatgacgccgtgtgcattggtttgagtccaagcatggaaggtggtgtgatgtgaaagttaatttgtcatccctcggtgcaaagcgaaggtatatatgaaaccgggtgtaaagggaaaacaaaataaatctacccgatgttaagtgcaatttactctttatttatttttacttatttgattatgctgtaaccgagttggatggcaaaccacgtatggtgtgatagatttacttccaccattatcctcctttttatctcctacatatgtgtttacagttcgcttatagtatgctgttgtatatgctctcactgcaaactataattaattaacctgaaaaatataacaaaggtcctttcagattgctgccgagtctaagggctcattcggaatgtaggattgaaaaaaatataggaataggaaaaatataggaataggataggaatgcaagtgtaaaacagatgatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccggccgcgccgcccgaagccaccaccctttccttttccggaagcctccccaatcctccgccattccccgcatagcgccccatgcccctaccgaccatagcctcccaatcccccatcgcctagctgcttcgccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatcgcgcgggagaggcgggagataaagaggatagagagcgcggcggcgcggcaggtcaccttctccaagcgccggcgcggcctgttcaagaaggccgaggaggtctccgtgctctgcgacgccgacgtcgcgctcatcgtcttctcctccacggggaagctatcccacttcgcaagctccaggtatgctgttctactcccacgcctggatatctctcgactccgcttcgtctcccgcgtttcgatagatctagctaggcgcgtttcctcccccggtctccctttgacttcgatgtctaagatccatccgcctgggctagggtttaacacgggatattttaactagtaacacggatctcaccatttccacccgttcagaaaaatcaatacagttttagaacgactcgtggttactttcgccccctttagatgtaggggatttactgtagtgtatgtagtctgcacctgtacttttgcagattattttcgaggtgttctttttttggtgcatgagtagcccatcttatttggccattcctactggaaatatcgtacgacaactcctgttatttgctgtttatgtgcgcgtggagttaatcgatgtgtgtgtcgcagtagtgctgtgttggtgataaagctagctagctctgctgatagcctacggtcgtacgtgtgattttatgtgctgatgcgtcgcgttttaccctctgatcaatggggggtctcgtgttttgtgcacggaaaacctcgcttcctgttgttgttttcttttgcaatgtgttaaatcattgcagaactgttgtttgatgagaaatatcctgttgttgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatgctacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatccttcttctacattggatgccataagattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttggacagtatcaccaccatgg

SEQ ID NO: 507 - DNA, 930 bp, Oryza sativa
  misc_feature (1)..(930): AB003322 3'-regulatory sequence engineered
  misc_feature (1)..(320): 3'-untranslated sequence
  misc_feature (321)..(930): 3'-nontranscribed sequence
ctgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaagtatgatcttgcgctatcttttgcgctatcttgcattcttgcgtaatatatatacattgtcgctgtcgttagatttcagttcttagctagcagccactagttggtgttaatagcttttccttttcctttcccttttcttttcatgatttacctgtcacgctatttcgcgggctgcaatttgttgcttgagatatgctctgcatggaagaacactatgcagatgcgctccagcattgattttcattatgggatactaacggggtatatgttgctgtgtgctacagatgtacagcgacgcagcagaaaaggtgacagctgcagtatatgtactgatctttccatttaatattaaaaaatctatatctttccgtttgctcgcatatccttctattttggattaagagcctcaccgtttgacttatctgcggaataagctaaataatatgtgttcttagcgatgtaaaagcaaaggctaaaaaaattaatgtcgatgaaaaaaccttaaaatcggcttcaaatttaaggttaaaaatttagattttggttaataagtataagcataagtgaaaagataagaccgtaaatggttggatttcagttgccagatttatt

SEQ ID NO: 508 - DNA, 32 bp, Artificial sequence
  Primer
  misc_feature (1)..(32): AF095646-1
tgttgcatgcatgcgtactggtgatggccgca

SEQ ID NO: 509 - DNA, 32 bp, Artificial sequence
  Primer
  misc_feature (1)..(32): AF095646-2
aatgtcttgtttattctgcaaacaaaaatagg

SEQ ID NO: 510 - DNA, 30 bp, Artificial sequence
  Primer
  misc_feature (1)..(30): AF095646-3
tgaagtccaagcttgctaataaaaacgctg

SEQ ID NO: 511 - DNA, 23 bp, Artificial sequence
  Primer
  misc_feature (1)..(23): AF095646-4
aagggtagggctgcacgaaatgc

SEQ ID NO: 512 - DNA, 28 bp, Artificial sequence
  Primer
  misc_feature (1)..(28): AF095646-5
caaaagttgagggattggatcgatcaga

SEQ ID NO: 513 - DNA, 34 bp, Artificial sequence
  Primer
  misc_feature (1)..(34): AF095646-6
gattggatcgatcagagatcgggaggggaagggt

SEQ ID NO: 514 - DNA, 30 bp, Artificial sequence
  Primer
  misc_feature (1)..(30): AF095646-7
gttttgtttccttcgatgggatgcgtattc

SEQ ID NO: 515 - DNA, 27 bp, Artificial sequence
  Primer
  misc_feature (1)..(27): AF095646-8
gaaggcgtacgaggtctccgtgctctg

SEQ ID NO: 516 - DNA, 31 bp, Artificial sequence
  Primer
  misc_feature (1)..(31): AF095646-9
cccttccttacccatgctggtaacaaatatg

SEQ ID NO: 517 - DNA, 43 bp, Artificial sequence
  Primer
  misc_feature (1)..(43): AF095646-10
atatatctcgagcggaccgtgttgcatgcatgcgtactggtga

SEQ ID NO: 518 - DNA, 38 bp, Artificial sequence
  Primer
  misc_feature (1)..(38): AF095646-11
atatatccatggtgggtttattctgcaaacaaaaatag

SEQ ID NO: 519 - DNA, 38 bp, Artificial sequence
  Primer
  misc_feature (1)..(38): AF095646-12
tatatagagctcagtccaagcttgctaataaaaacgct

SEQ ID NO: 520 - DNA, 38 bp, Artificial sequence
  Primer
  misc_feature (1)..(38): AF095646-13
tatatacccgggcggtccgaagggtagggctgcacgaa

SEQ ID NO: 521 - DNA, 526 bp, Oryza sativa
  misc_feature (1)..(526): CL019873.131
agagagagagagagagagagagagagagagagagagagaaaagaaggcaaggagcactccggccagcacagccgatggtacgagagcatggctagctagccgagctacttagctactacatccatgatccatccatccccaacaaacggagcaagactgcaagggagagggagagagagggaagcttgcaggctgcagctaactagctaggcaaggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctggtactactaataattctctcttgcaagctctcgccccttgcagagaattcatatatatctcgccc

SEQ ID NO: 522 - DNA, 30 bp, Oryza sativa; identical to SEQ ID NO: 496
  misc_feature (1)..(30): OsMADS8.P1

SEQ ID NO: 523 - DNA, 29 bp, Oryza sativa
  misc_feature (1)..(29): OsMADS8.P2
ccattttttgcgaaatgccaaatcctggc

SEQ ID NO: 524 - DNA, 4283 bp, Oryza sativa
  misc_feature (1)..(4283): AF095646 5'-regulatory sequence
  misc_feature (1)..(2001): 5'-nontranscribed sequence
  misc_feature (1)..(4283): n is a, c, g, or t
  misc_feature (2002)..(2320): Exon
  misc_feature (2055)..(2055): n is a, c, g, or t
  misc_feature (2321)..(4268): Intron
  misc_feature (4269)..(4283): Exon
tgttgcatgcatgcgtactggtgatggccgcatagcagctggtaactgaacagtggctcggagagggacgtctcgtcgtgccgccctgtgaatgcctgtacacccccgagcaccgtaaattccgagctagctagcttggggacgttgaaagcgtcgtcagatctgtattcaaggcagttgatcgaccatgtacttctctgctcctttatatggggttacagtataccgtatagctccatgcatgcatggtggaaacgatttgcgtggttgctgtgcaagtgcatgtacatgtgcgtgtgattgtttgtaccctgttcctggtttcatgcgattagatggccgagtgcacatgatgagctagcctatccgtggactacaacacatgcgatgagcatgtcagatggccgatggccagggaacagctggggacttggccacgcctcggagagggctaatcgagaaaggctagctaggtataggcgtatagctactacgagcatctacatgatcacactgcacatatgtacgcgtacatggtatttgcatatcagtccatacgagtaaatgtgtagccatgcatgaacttatgaattgagccctctctcaactgtgtcactttgtgatggagtattttattttttcaattttttacgcactgacgggcttcgcgggcctcagattctccagtcacgtgcaaaggatacgtacggcgtggcaggccaccggccggtttcctggcacacggcccagtcagtggctcaggcgagggaaatccgcgtacggtgaaacccaaccccgatgccggcgataaatccgtttgctgcttgacatgagtgggccgcctgagaggacaaccgggatccagttagcgagtcaatgacgctgacacttgggtcccttctcgcctggacccacatgtcagtgacagatgatccacgttccgagaagatgacgtacggtttcccgtggatttgcgctaccaggacgcgtcaggttacaaaggggctttgttaggctatgttcttcctagttttcctaactcacatctatcgtttttcacgcatataacttttaaacagctaaaaacgctgtgctttttgcaaaaaaaaattatacgaaagttgttttaaaaaatcatattaatctattttttaaataaattagttaatacttaattaattatataataatacgtgtttcgttttacatgatgagcgcaatccctcctcccgaacgcaacctaaggggatgtttgggtccaaacaccccccctaatacttatcatgtcatggacgaacaaataatggcaaatagcaagtcaacaaagctcaaaaactggaatttctcaggcaccggccagatgtgtcagattaggacttcactacaatcgacgtgccataattcccagcagttaatgctttggcgggaagattaatcacgtgtgtgtgttttacttatttttctggggtgctctagggctcctgtgaatatctctggagactggtcgtgggtcgacagaaccactgaaccagcagggtgccatgcagccagtgagcattacatgcatggtttggtctagttctaggagtgtactacatgtgcgtgcacactgcaagtgtagccagagttcatgtatggatcattgcacatgttgttgtgtggtctcatgcatgcagatgacgatcatgacattgcgtgtttgaatccaggttgaggcatgtgcattgcacatttgcactggctgccgtgttcacctgttcgggctcgtgcttaccagctagggtaatgccgggcatgcaggtactagctgctcctggcacccagttactgcatgcccggtttcctcgtcgtcgcaagttacctgtccttaaagttggtagctcaagagagaggccaaaaagatgaaggaaagcggcaaccaaatttaacaccgcaacagtagtactactagctgggcccctttgggatgtctcctctctccactgatattcctcctcttcctagatcatatctcatcccatcatcggtcatattctcctcagcttcatgttgctnagctataggcgaatggttgacaagagtactagttagcttaataatatagctttgcaaaagttgagggaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccgggtaagcgtgtgcatgatccgttcagtaccctaatcgtatgtgattcttgcagatctggtgattaatttctctcttccctttggtttgttttgtttccttccatgggatgcgtattctcgtttgcttcctcagcttaaatccgaaattgtttcttagattttttgttaccaagtatatatatgtgctcgctggtttattttgctatatggttttttgtttctcgctagcgtgcatgtgttttcatacatcttttaggcttaggtaatcttgccggatgtatgcctagctcttgctacttgcatacttgggtaatcttttcataatgaaaatcctccagccctaactcaataaagcacataatatctcttcttcttcttcttcttcagaacctaaagagcattgatttctttcattcgtgcgtgtgcccggcgtgcgcatgtcaggagcagctaggtatatgaggctctgaggcgcaagttttctgattgcaagagtgacttgaaggggaaagtgatggggtctgctgtttccatttagatgccgcaccaagaactttgtttaaatcttttttttcagaattattgcctaatttgatatccatatatttcattcctgcaagtatataacatcttctcttgccatctctcaggtaaattatattacatatgaaccatgcatatgcctctcttttcttttgatgcatttgtgttttcctgaaaggttcgtgttcccgtttaaataaagctttcagatttttttcctgataggtacatgagtttttttttcatttatttgattaaaccctcaaacattatcatcactttagctgcatatatatgaattcgatctttcaaatctcttatgtgtatacgctcttttgcaagattttgtgattctggtattattatttttttcttgttgcattgcctcttgctaatacatgaaggtaaccgagaggggcttatgcacattttgagttgaatgttagtaattgctatatgtattgacgggaaaatcataaatatatatagacgaaaaataactgtgttgattgaaatgcatggatcgaattgaacaccgtttagttgtggaaattcttttatttcttctccggtgatcagtgtgtagggcttctctccagggaccatcagagcaggcgggccatgaaaaaaattttgaataaagtaaatacattacgaaagagttttgtgttattgtgaccggcaactcttgttgctgaacttgctgcttgaacctggtatgcacatgaatatggtggtttttctttttttcatcatagtttattttgcaacatttactttggagtcgccaagaacacacatataaagctttacttagaaatattctttttatttgctaataagtgattcggataagcatatgaataagcgaaacaatgaggctttgtgtccgaattagagcatcattaaacaatttctgaaaacaatttcttcagtagcgatgatcgaaagggattcgttgaactctaacaattattaaaattgttcttgaccacaaattcacctggccatatgattatcattacctattttctgcaattaaatttatgtattttcattctgttatattagtctcctgctgtttaaaattacatatcattctaccttgtcctaatttatgtcaaacatttctatccttgacagtcaatttctagaaatttgtataagttaacaacatgcgaattatatattacaaaagtatttctcatgatgaatctaaaaacataaatcttatgatattaaactatatgaaattttaaattttgatggcaaaacgtacaaatgtttaacttagaacaaaactagaatgcaagtaatttcaaatgcagggcgaagagtagattttattgcattcggctttatgtatgtgagtaagtaacatatcctaaacctatttttgtttgcagaataaacaagacatt

SEQ ID NO: 525 - DNA, 971 bp, Oryza sativa
  misc_feature (1)..(971): AF095646 3'-regulatory sequence
  misc_feature (1)..(279): 3'-untranslated sequence
  misc_feature (280)..(971): 3'-nontranscribed sequence
tgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatctatctatacgtaccatactaattggcaaattttgtgtagctaccggattaagtgtgctacctactgtaaagatcccaagagttttgcatgaatatatttggctagagcgatcatttaattctatttattcaaaattttctaatgtgcacaatgggacttgtgtgaattgttagaccattgttatagaacacctaaattcgaagaaaccttcggtagcatatgtcctacagcgcaaacacaaacaaaacagagcatacacaaacataacacaaacctattcatgccctcaactaccgttatttcccttaggcggtgactcttatatttgaaggtatgaaaatttgaaaatggggtcaatatttaaattatggtgtacaaaatatgaggtttaagaaggcaactcgtttttttcgagcttgttttatttagtaaagggtttttaaaatcttcaattcgactagttttacgtactaaaatacatgactagtaattaaatttggactagggtgttagataggtccataatatcgtaaactgcacatatatcacccatatatgattaccaacgtggttgtctacggaggccaaaagttcacattcaacccccttccttacccatggtggtaacaaatatgcgtttaacccctccgagtttgttaccaactatgacaaaaagatgccgcacctcgatgtcccctcccctccttcgctgcacttcactgtctccttcccctccctagctgcatttcgtgcagccctaccctt

SEQ ID NO: 526 - DNA, 4312 bp, Oryza sativa
  misc_feature (1)..(4312): AF095646 5'-regulatory sequence engineered
  misc_feature (1)..(2029): 5'-nontranscribed sequence
  misc_feature (1)..(4312): n is a, c, g, or t
  misc_feature (2030)..(2348): Exon
  misc_feature (2083)..(2083): n is a, c, g, or t
  misc_feature (2349)..(4296): Intron
  misc_feature (4297)..(4312): Exon
tgttgcatgcatgcgtactggtgatggccgcatagcagctggtaactgaacagtggctcggagagggacgtctcgtcgtgccgccctgtgaatgcctgtacacccccgagcaccgtaaattccgagctagctagcttggggacgttgaaagcgtcgtcagatctgtattcaaggcagttgatcgaccatgtacttctctgctcctttatatggggttacagtataccgtatagctccatgcatgcatggtggaaacgatttgcgtggttgctgtgcaagtgcatgtacatgtgcgtgtgattgtttgtaccctgttcctggtttcatgcgattagatggccgagtgcacatgatgagctagcctatccgtggactacaacacatgcgatgagcatgtcagatggccgatggccagggaacagctggggacttggccacgcctcggagagggctaatcgagaaaggctagctaggtataggcgtatagctactacgagcatctacatgatcacactgcacatatgtacgcgtacatggtatttgcatatcagtccatacgagtaaatgtgtagccatgcatgaacttatgaattgagccctctctcaactgtgtcactttgtgatggagtattttattttttcaattttttacgcactgacgggcttcgcgggcctcagattctccagtcacgtgcaaaggatacgtacggcgtggcaggccaccggccggtttcctggcacacggcccagtcagtggctcaggcgagggaaatccgcgtacggtgaaacccaaccccgatgccggcgataaatccgtttgctgcttgacatgagtgggccgcctgagaggacaaccgggatccagttagcgagtcaatgacgctgacacttgggtcccttctcgcctggacccacatgtcagtgacagatgatccacgttccgagaagatgacgtacggtttcccgtggatttgcgctaccaggacgcgtcaggttacaaaggggctttgttaggctatgttcttcctagttttcctaactcacatctatcgtttttcacgcatataacttttaaacagctaaaaacgctgtgctttttgcaaaaaaaaattatacgaaagttgttttaaaaaatcatattaatctattttttaaataaattagttaatacttaattaattatataataatacgtgtttcgttttacatgatgagcgcaatccctcctcccgaacgcaacctaaggggatgtttgggtccaaacaccccccctaatacttatcatgtcatggacgaacaaataatggcaaatagcaagtcaacaaagctcaaaaactggaatttctcaggcaccggccagatgtgtcagattaggacttcactacaatcgacgtgccataattcccagcagttaatgctttggcgggaagattaatcacgtgtgtgtgttttacttatttttctggggtgctctagggctcctgtgaatatctctggagactggtcgtgggtcgacagaaccactgaaccagcagggtgccatgcagccagtgagcattacatgcatggtttggtctagttctaggagtgtactacatgtgcgtgcacactgcaagtgtagccagagttcatgtatggatcattgcacatgttgttgtgtggtctcatgcatgcagatgacgatcatgacattgcgtgtttgaatccaggttgaggcatgtgcattgcacatttgcactggctgccgtgttcacctgttcgggctcgtgcaaaagttgagggattggatcgatcagacttaccagctagggtaatgccgggcatgcaggtactagctgctcctggcacccagttactgcatgcccggtttcctcgtcgtcgcaagttacctgtccttaaagttggtagctcaagagagaggccaaaaagatgaaggaaagcggcaaccaaatttaacaccgcaacagtagtactactagctgggcccctttgggatgtctcctctctccactgatattcctcctcttcctagatcatatctcatcccatcatcggtcatattctcctcagcttcatgttgctnagctataggcgaatggttgacaagagtactagttagcttaataatatagctttgcaaaagttgagggattggatcgatcagagatcgggaggggaagggttgagctgaagcgcatcgagaacaagatcaaccggcaggtcaccttctccaagcgccgcaacggcctcctcaagaaggcgtacgaggtctccgtgctctgcgacgcggaggtggcgctcatcatcttctccagccgtggcaagctgtacgaattcggtagcgccgggtaagcgtgtgcatgatccgttcagtaccctaatcgtatgtgattcttgcagatctggtgattaatttctctcttccctttggtttgttttgtttccttcgatgggatgcgtattctcgtttgcttcctcagcttaaatccgaaattgtttcttagattttttgttaccaagtatatatatgtgctcgctggtttattttgctatatggttttttgtttctcgctagcgtgcatgtgttttcatacatcttttaggcttaggtaatcttgccggatgtatgcctagctcttgctacttgcatacttgggtaatcttttcataatgaaaatcctccagccctaactcaataaagcacataatatctcttcttcttcttcttcttcagaacctaaagagcattgatttctttcattcgtgcgtgtgcccggcgtgcgcatgtcaggagcagctaggtatatgaggctctgaggcgcaagttttctgattgcaagagtgacttgaaggggaaagtgatggggtctgctgtttccatttagatgccgcaccaagaactttgtttaaatcttttttttcagaattattgcctaatttgatatccatatatttcattcctgcaagtatataacatcttctcttgccatctctcaggtaaattatattacatatgaaccatgcatatgcctctcttttcttttgatgcatttgtgttttcctgaaaggttcgtgttcccgtttaaataaagctttcagatttttttcctgataggtacatgagtttttttttcatttatttgattaaaccctcaaacattatcatcactttagctgcatatatatgaattcgatctttcaaatctcttatgtgtatacgctcttttgcaagattttgtgattctggtattattatttttttcttgttgcattgcctcttgctaatacatgaaggtaaccgagaggggcttatgcacattttgagttgaatgttagtaattgctatatgtattgacgggaaaatcataaatatatatagacgaaaaataactgtgttgattgaaatgcatggatcgaattgaacaccgtttagttgtggaaattcttttatttcttctccggtgatcagtgtgtagggcttctctccagggaccatcagagcaggcgggccatgaaaaaaattttgaataaagtaaatacattacgaaagagttttgtgttattgtgaccggcaactcttgttgctgaacttgctgcttgaacctggtatgcacatgaatatggtggtttttctttttttcatcatagtttattttgcaacatttactttggagtcgccaagaacacacatataaagctttacttagaaatattctttttatttgctaataagtgattcggataagcatatgaataagcgaaacaatgaggctttgtgtccgaattagagcatcattaaacaatttctgaaaacaatttcttcagtagcgatgatcgaaagggattcgttgaactctaacaattattaaaattgttcttgaccacaaattcacctggccatatgattatcattacctattttctgcaattaaatttatgtattttcattctgttatattagtctcctgctgtttaaaattacatatcattctaccttgtcctaatttatgtcaaacatttctatccttgacagtcaatttctagaaatttgtataagttaacaacatgcgaattatatattacaaaagtatttctcatgatgaatctaaaaacataaatcttatgatattaaactatatgaaattttaaattttgatggcaaaacgtacaaatgtttaacttagaacaaaactagaatgcaagtaatttcaaatgcagggcgaagagtagattttattgcattcggctttatgtatgtgagtaagtaacatatcctaaacctatttttgtttgcagaataaacccaccatgg

SEQ ID NO: 527 - DNA, 968 bp, Oryza sativa
  misc_feature (1)..(968): AF095646 3'-regulatory sequence engineered
  misc_feature (1)..(276): 3'-untranslated sequence
  misc_feature (277)..(968): 3'-nontranscribed sequence
agtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatctatctatacgtaccatactaattggcaaattttgtgtagctaccggattaagtgtgctacctactgtaaagatcccaagagttttgcatgaatatatttggctagagcgatcatttaattctatttattcaaaattttctaatgtgcacaatgggacttgtgtgaattgttagaccattgttatagaacacctaaattcgaagaaaccttcggtagcatatgtcctacagcgcaaacacaaacaaaacagagcatacacaaacataacacaaacctattcatgccctcaactaccgttatttcccttaggcggtgactcttatatttgaaggtatgaaaatttgaaaatggggtcaatatttaaattatggtgtacaaaatatgaggtttaagaaggcaactcgtttttttcgagcttgttttatttagtaaagggtttttaaaatcttcaattcgactagttttacgtactaaaatacatgactagtaattaaatttggactagggtgttagataggtccataatatcgtaaactgcacatatatcacccatatatgattaccaacgtggttgtctacggaggccaaaagttcacattcaacccccttccttacccatgctggtaacaaatatgcgtttaacccctccgagtttgttaccaactatgacaaaaagatgccgcacctcgatgtcccctcccctccttcgctgcacttcactgtctccttcccctccctagctgcatttcgtgcagccctaccctt

SEQ ID NO: 528 - DNA, 30 bp, Artificial Sequence
  T6PP-EC-5
  misc_feature (1)..(30): T6PP-EC-5
catggaccatggatttgagcaatagctcac

SEQ ID NO: 529 - DNA, 30 bp, Artificial Sequence
  T6PP-EC-3
  misc_feature (1)..(30): T6PP-EC-3
atcgcagagctcacactgagtgcttcttcc

SEQ ID NO: 530 - DNA, 41 bp, Artificial sequence
  T6PP-QC
  misc_feature (1)..(41): T6PP-QC
ctttattatgctggaagtcatggtatggacataatggcacc

SEQ ID NO: 531 - DNA, 1116 bp, Oryza sativa
  CDS (1)..(1116): OsT6PP-3
atggatttgagcaatagctcacctgtcatcaccgatccggtggcgatcagccagcagttgttgggcggcctgccttcaaatctgatgcagttttcagtcatgcccggtggctactccagctctggcatgaacgttggtgtcagtaggctcaaaatcgaggaagtccttgtcaatggactgcttgatgccatgaaatcctcgtcacctcgcaggaggctgaatgtagcatttggcgaggacaattcatctgaagaagaagaccctgcttacagcgcttggatggcaaaatgtccttctgctttggcttccttcaagcaaattgtagccagtgcacaagggaagaagattgctgtgtttctagactatgacggcacactgtcgcctattgtggatgatcctgacaaagcagtgatgtctcccgtgatgagagctgctgtgagaaatgttgcgaagtacttccccactgcaattgtcagcggaaggtcccgcaataaggtgtttgaatttgtaaaactgaaggagctttattatgctggaagccatggtatggacataatggcaccttcagcaaatcatgagcacagtgctgaaaagagcaaacaggccaatctcttccaacctgcacacgactttctgccaatgatcgatgaggttaccaagtccctcttgcaagttgtcagtggaattgaaggtgcaactgttgagaacaacaaattctgcgtttctgtacattatcgcaacgttgcagagaaggattggaaactggtcgcacggctcgtaaacgaagtgctggaggcttttcctcgtctcaaagtaaccaatggacgaatggttttagaggttcgtccggtgatcgactgggacaagggaaaggctgtggagtttctgctccagtcactcgggctaaatgactctgaaaatgtgatccccatctacattggagacgacagaactgacgaagacgctttcaaggtacttcgacagcgaaattgcggttatggaatactagtttcacaggttcccaaggaaactgaagccttctactcgctgagagatccatctgaagtgatggagttcctcaatttcttggtgagatggaagaagcactcagtgtga

SEQ ID NO: 532 - protein, 371 aa, Oryza sativa
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKSKQANLFQPAHDFLPMIDEVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 533 - DNA, 15978 bp, Oryza sativa
  misc_feature (1)..(15978): OsMADS6-OsT6pp-3 expression cassette
cggaccgctaggacgatggtgtgatgtgggaacacgaagaaaacatgaggaaaaaatattaaaatgaatttcccacttaaaatgcatcaaataaaaaaaataaagaaacgaccgggaatagacacagggtttgtgaactagctagggcaaacatcatatggtcccttgctgatgcacaagtacattgagatgtcatttcaattctgtgcatcatatgcatgtggtcccttgctgaatattactcttgaaatatctaccagtgccaatctattgcatgacttaattaattcacaggttttgttgattacattattagtaagcttgagagcacaagctcaatggatttttctataaatggggatcattttgcaattttctttgtcgtgcaaagttagccttctttattactacttctgtttttaaatatacgatcctattgacttttggtcatatatttaaccatgtatcttatttagatagtttgcgcaaatatatataccttcaatgataaaattagttacaatgaaacaaatgatatttacgcaattctttttactaaacaagtcacaagaagtacctgcagcaatatatgttggaaccgtgcagtagatcgagcctagctacgcaaaaaaacaaaaagagaaaaaaagggaaaggaaaaacattaatcatgcatgagcagtatgcccggcaactggaatttgtcaaagatatggggagaggagaataatacaagtactactactacctagctctaccatgcatatgcacccaaaggcaaactggattattggataaagcacagatgctggcaaaacaatccttaagcctcccctccctgcttctttatttttgggcagcctctaccggacggtgccgtggtccattggaccagtaggtggcgacatacatggtttgggttaagtctaggagagcagtgtgtgtgcgcgcgcaagagagagagactgtgagtctgggagtagccctctcccctcctttggccatcttcctcgtgtatatgcatatatgcatcatcgcaacggtgtatatttgtggtgtggcgggtgtggcattggattgcccccattttggctcgtgcttcccagttagggtaaaacctgtggtaaacttgctagccccacgccaaagttacccttctttattgttgaaagggagaggaggtgtgtgaattgtgatggagggagagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgagtcgacgaggggaagagttgagctgaggcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccatcaggggagccccttctggtattaagatctttccggcacattgattttcatactttgtgatgaccctggaagaatcggcgtagcagcgtagcaccgctccattttggtcttaccctcacctccccatgctatgaactgatcaatttcattgttcttcatcacccttctcctagctttccacttccttcggatctcatgccatgtttctcagcatgaatcaaatttaattcgtgttttctacttccatatatactggaagaaatttaattagatctatttttgctcgggaggtcttcatactttgagttctgatgccatcaccttatttcccccccccccttctcttgttctatcttcttcctcatcttggcttgatcattttgatctgtcagttatagcatgatgcattctcaatttgactgtatgtaagttcaaccggaaatatgttgaatggattttctatatatcaacacttgatgtcaggcctgcatctgtttcgcttgtggtggtgtggccaaaattgtctatatttgatctttgctcttctttctcctcatttcatgacgattcctactacggcttaaaccattctttattctttactaatcatggatgttgcttgactcctagttgtttcgtactagctcaacttggagatcttttcattatttgcctagttggtgggtacgtttgtgacagatctaaaatggtgcacgaaaagttttacttattatgaaaaaagggagcttaacagggtaatttctctatttattcgtgatgacattttttccttgataagggggattttttataatctgcactcacatgtttatatgtaaaatctagctcttttgttttgtttttggcatatttcccgctaagtatagagtttatgtggataacattataacttttcaagatccaatccacatctttgattgtgaaaatcatacaatagggaaaatcaactgaagggttaattagatgctatatgcatatatatatatatgtgcgcgcgcgcgcgcctgaatttaactatgtatgcatccaactgtttcattgaaaaagatttgatatttttcagtctattctttttcgagtatatatttaatatgtttcaatctgttttgaccattataagataaagcctatattcaccaggcatttgagatgatcttttcatgcatgaaaaagctgttgttatcacttcaactaaccagacgatctaacatgtatttgtataagaaacagaccttgatttccttctgtaaaatcatgcatgtgttcgttttgaattggagtcggcgcgcctgtgttttgaccgtcaggaaagtcttttttttccctgaatagtcaagggtctatacttcttgaagcaattgggacactaatcaattattgtttatacctcggaccatcttttccttcttcacaccactaatcagtttatgccttggaccattaattgtgttgttcacaagcttcttgtttatggtttacaaagcattcgcctagatttgtgtgtgtctctacacatcgatcacttttaaatacttgtcgctttcagttattcttttaacgtttggttatttatcttatttaaaaaaattatcgtattattatttattttgtttgtgatttactttattatcaaaagtatttcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgcagcataaccaccatggatttgagcaatagctcacctgtcatcaccgatccggtggcgatcagccagcagttgttgggcggcctgccttcaaatctgatgcagttttcagtcatgcccggtggctactccagctctggcatgaacgttggtgtcagtaggctcaaaatcgaggaagtccttgtcaatggactgcttgatgccatgaaatcctcgtcacctcgcaggaggctgaatgtagcatttggcgaggacaattcatctgaagaagaagaccctgcttacagcgcttggatggcaaaatgtccttctgctttggcttccttcaagcaaattgtagccagtgcacaagggaagaagattgctgtgtttctagactatgacggcacactgtcgcctattgtggatgatcctgacaaagcagtgatgtctcccgtgatgagagctgctgtgagaaatgttgcgaagtacttccccactgcaattgtcagcggaaggtcccgcaataaggtgtttgaatttgtaaaactgaaggagctttattatgctggaagtcatggtatggacataatggcaccttcagcaaatcatgagcacagtgctgaaaagagcaaacaggccaatctcttccaacctgcacacgactttctgccaatgatcgatgaggttaccaagtccctcttgcaagttgtcagtggaattgaaggtgcaactgttgagaacaacaaattctgcgtttctgtacattatcgcaacgttgcagagaaggattggaaactggtcgcacggctcgtaaacgaagtgctggaggcttttcctcgtctcaaagtaaccaatggacgaatggttttagaggttcgtccggtgatcgactgggacaagggaaaggctgtggagtttctgctccagtcactcgggctaaatgactctgaaaatgtgatccccatctacattggagacgacagaactgacgaagacgctttcaaggtacttcgacagcgaaattgcggttatggaatactagtttcacaggttcccaaggaaactgaagccttctactcgctgagagatccatctgaagtgatggagttcctcaatttcttggtgagatggaagaagcactcagtgtgagctcgctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagtcgttttaactttagtcaaagttaaactgtttcaagtttaaccaagtttgtagataaaagtagtaacatattcaacacaagacaaatatattataaaaacatattgaattatagatttaattaaattaatttggtattgcaagtattactaaatttgtttataaatttggtcgaatttaaaatagtttgactttaaccaaagtcaaaacaaattataatctaaaacaaaggtaatacattgtatcactctcatgaatggattgtaacatacattaatttaattactattttagttcttgtgcaaaagttgaaaacgatttatgtttggaatctttttgtggtgtatatatatgaaaccattcctctaccatccttccccaaccataatcctcacaaccgttagccccattgtgatctcacccagttgctagcctcttttgtcaccttgtcacagctctcctccattcattacacaatggcatcggaccgcgatcgcttaattaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatctgctagccctgcaggaaatttaccggtgcccgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagatcgttcgtaatctggcggcaaagtctgatattccaatcataattatcagtggcgaccgccttgaggagacggataaagttgttgcactcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggaattaattcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgctgcaggaattggccgcagcggccatttaaatcaattgggcgcgccgaattcgagctcggtac

SEQ ID NO: 534 - DNA, 26 bp, Artificial Sequence
  T6PP-RTPCRF
  misc_feature (1)..(26): T6PP-RTPCRF
gacagaactgacgaagacgctttcaa

SEQ ID NO: 535 - DNA, 19 bp, Artificial Sequence
  6906-tr
  misc_feature (1)..(19): 6906-tr
ctccaacttctgacagctg

SEQ ID NO: 536 - DNA, 8709 bp, Artificial sequence
  OsMADS5-GUS-expression cassette
  misc_feature (1)..(8709): OsMADS5-GUS expression cassette
ggcgcgcctgagcaggtagccggcgaccaatcgcgagcgtcgccaacacgctgccttttctcaatgcatggcgtgggccccaccaggggccatttttttctctttaaaaaggagaaaagcaatcagagttgagacctccgagcgcgagacccaacatctatccctgggcccgcccaaaatccatttccaggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattagatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaatcctaaggataacttcgaataaatgattaaatcttaacattttctttgaaattcatatggaacaaacaatgctatagagactttggaggaattaaagttattaagagctctaaccttttaaaagattaccaatgagtctatataggtagttgtagccaaagaatcaaggatactccgatcgtttgagtggaaataataactcctacatgtaaaattaattaaggcctctatttgtatgaaaaaacataaaaaaaggatttttaatcttattgaaaaaaaaatcctaaagataacttcgaataaatgattaaatcttaacattttctttgaaattcatatggaacaaacaatgctatagagactttggaggaattaaagttattaagagctctaaccttttaaaagattaccaatgagtctatatcactcattcaattcctacgtttttcaaatggcctacatactcaaatggttgttcttgttttttttttctctctttcgcaattacaatggacctgctcgcaacttttgcaatctgtctatgttttttatgtttagcagctgcgctgctgcagctgaacaaaaaaaaacactgtgacgattggctgcaacacaatgaaaatgagtgcagccgaacagagccaatatcttcaaaatcttgtttttttcatcttccatttttcaatcatttattttaaaggagcccttaattaatggttaagaaattttatatcttgcattttaaaggataatgctgataatcaaatagactacggtgaaaaaaactttaaaactaaatgtaagattaaatttcacacttaaattttactagctacggctgataattaagctaacaacttactgtgactgacttggtcatagggggagagagagagagagagagagagagagagagagagagagagagagagagagagagagagagagagagagagagagagagagagagagagaaaagaaggcaaggagcactccggccagcacagccgatggtacgagagcatggctagctagccgagctacttagctactacatccatgatccatccatccccaacaaacggagcaagactgcaagggagagggagagagagggaagcttgcaggctgcagctaactagctaggcaaggagagagaggagatagatcaagaagagattttgagaccgagagagagctagagagagctcgacggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctcctggtactactaataattctctcttgcaagctctcgccccttgcagagaattcatatatatctcgccctaattctaatgcaaagttagttaattagtttgcagccaagaaagactagttttctcgttatgagtttttgaagctccttgtgatttctgggctagctactgcccacctagctaccatgttctaattaatcatcagtccgtgtgtttaattaacatctcatgtttgtccgggaagttcttacacccagtcttttccctgctgctttgtttgtgtttaaaacatatatataccagcatttcgtttgtatttgttggaatttttaccaatctttctcaaagatcctgattttagttaatttttaccacctcgatcgtgatcatatacatgctcatagctgattaactaacctgttcctgttgttgttttggttaaagaaagagagacaggacagccgttctagtcacctgatggctgccgatctgtgtgtgtttgccgtcccctaattcctctttacggtttgcagttgccatagagactagtactctgtcaacagaatcaagcatgcaatctctccatgcttgcttccatttgtaggctagagctgcatgctagatatctctaagctgatctcttccatgcttgtctctctagctctttcattagtgcatgcaattttcagagtgaagtagatgagacccctccagatctgcacaagaacatggcatatagtactactagtacgcatattgcatcttaattctcatattgcacaagcacatatactaggctgcagtgccttttccaatggcaagttatttttgtcagatcttaattaggagcatcttttccaatggcaagttgggagggtttcttgctctggttttactgttccattgggaactcgcaacataggggttgttcttgggttccactgttccattgagtctctctctctttctctctagctaggtttctctctctacgtcttgtcaaatgtctcggctgtactagtgtgcatgcgattgcagctgcagaagcaagaggaaaagtagtaatgcagcagcaggaggaaaagtcgtaggagtactcgtggagataagcatctctgtatcgatcgtctcgtcggttgttatcctccctgtggatatgtacacggtccgtgtttagatccaaaataattcatcaaacttttaactttttcatcacatcaaaacttttctacacacataaacttttaacttttacgtcacatcgtttcaatttcaaccaaacttctaagggcccctttgaattggaggaaaaacataggaattttagaggatttcaatcctatagaaaaatttcctatgaagccctttgaaacaaatgattgaatcctatccaatcctttgaaattcctatggaatggacaatcctatagagattttggaggaaatttagcaagagcttcaacctcttgctaactttcctttgagtctatctctctcatctaattcctgcgtttttcctgcggttcaatcaaacggtcattcatgtgtttttcctgcgttttgcaatcctctgttttacacttacattcctaccaaaatcctacgtttttcctattcctacgttttttcaatcctgcgattcaaagggaccctaattttggtgtgaactaaacacagcctagttgtagttgtgtggtacgaaagatcgaattgatttctagctaggcgtggccggacacacacccaagttaattcactgcattcgtaatttcatactcctatgcgattcataatttcacatgcgatgatgcgaatagattgatttgatcatttgaacattgtcatatggtatgcaaacaacttatcgtgcgagaggcgtgcgtgtcgattgccaaaattttctgtcagcgcacagtacaggctagctagtctggaacgaggttgtgtcgatttacaaggcacagttactagctaccctaccgttagggtatgtagtaggagtacttgtgtaccaaaagtttggattggttgaattttccaagctcctagtcacaatgtactccctccttttccctccccaaaaaatatactccttctatccagtatccacaaagaaaataatgtaactctagcatttaaaagacaaattagcaagaagtaaaatgattgggagtgaaattgtggttgggggtaaaatagggatcataatttgaatgaggggggtggttgtagggaaaaatagtactgcactcctttagaattgcacttattttgaaacaaaatctgaatgttagttacaattgtttttttctaaaaaaacagagtacaattttctaataatttaacacaaatcaatcaaatatatacatgtttgtaagtgatagtgtttatagctccaaacagggtttgaaatttcggctcgaaatttcgcccccaccgaaatgttcatatctcgcccgaaactttcggttgtttgcaaatttttgtgaatttggtcaaattttattcaaatccattcaaaatcagtcaaaaattcaaaaaaaatcgtacgaaaaaaaaatctgaaattttggttatatcgcccacctgcggtagaaatccttctttcgaaatttaaaaccctggctccaaacttagggtgcgctgtgcacataccctagaaaatataactgatatatgctccattaattatgaaaggcaaaataaactgatcatgcatatgtaggaaaatcgggttgtatatacatgtatttaaacaacaaaatataatataacaactttaactgatactgcattgaaaatagttttgtggtccactgattttcttttttgtaacagtatccaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatcaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgcactagtcccgggccatggggggtctagaatgaattgcttatcacattaatggacatctcctatgttggatgtggtgtttgacgtaatgctctcttttacatgcgggttttaccttaagtgtgtgtgctaaatttagtgcgtttgtttatgctcttttgaactgaacaaaggaatgatcccggtttgattgatgaatgctgcaagaacataatctatatgttagtctgaattcagtatgtaatgaagatgttttgttactaattaataaatacgaagtaaacaattaactgaccactaatcatgtcagcttagatatatgcttataattatgttgcctaattcttaccttaattggtctgtgttcaatatatgtgagtataccacactagttgtttctcagcatgaactaattaagtgtgagtagataaaacgagtaaattggaatgtaagaaaaggtaaaaataaagtacttattaaagagagagtgcatgccaaaagtacgaagagaaaaacttagaatattagttacaatataatatataatcaagtgcttcgttcgaacccatacatgtttgtttttcttatttttctaatatttcttcaccatataggttccccaggttgcactccgaaaggtcgtgtaatgtgtatttagtagcacacatagttacatcactgcttattttctcatccactagccacaagattgtgtgcgtgtgaccatctcaattagatccatctcctccttcacatgcacggtattgatttgtgctagacctgccggtgtctccaatggtgatgatccagctgattcatcgtcttggaggacatcatcgtcccatgccatttccatatctatctcatggccaatcttgttagcataatcaatgtggttgaagatgtagttcatgtcaacatcatcatctatgttgtaaacctggtacggcatctcgtccttcgtttcgaacaaatgatcacacatatcaaggcataaatcatcataggtagagaccaggagttcttcacaagagttggtctggatgtagctgttctcatccggcgcgcc

SEQ ID NO: 537 - DNA, 7954 bp, Artificial sequence
  OsMADS6-GUS expression cassette
  misc_feature (1)..(7954): OsMADS6-GUS expression cassette
cggaccgctaggacgatggtgtgatgtgggaacacgaagaaaacatgaggaaaaaatattaaaatgaatttcccacttaaaatgcatcaaataaaaaaaataaagaaacgaccgggaatagacacagggtttgtgaactagctagggcaaacatcatatggtcccttgctgatgcacaagtacattgagatgtcatttcaattctgtgcatcatatgcatgtggtcccttgctgaatattactcttgaaatatctaccagtgccaatctattgcatgacttaattaattcacaggttttgttgattacattattagtaagcttgagagcacaagctcaatggatttttctataaatggggatcattttgcaattttctttgtcgtgcaaagttagccttctttattactacttctgtttttaaatatacgatcctattgacttttggtcatatatttaaccatgtatcttatttagatagtttgcgcaaatatatataccttcaatgataaaattagttacaatgaaacaaatgatatttacgcaattctttttactaaacaagtcacaagaagtacctgcagcaatatatgttggaaccgtgcagtagatcgagcctagctacgcaaaaaaacaaaaagagaaaaaaagggaaaggaaaaacattaatcatgcatgagcagtatgcccggcaactggaatttgtcaaagatatggggagaggagaataatacaagtactactactacctagctctaccatgcatatgcacccaaaggcaaactggattattggataaagcacagatgctggcaaaacaatccttaagcctcccctccctgcttctttatttttgggcagcctctaccggacggtgccgtggtccattggaccagtaggtggcgacatacatggtttgggttaagtctaggagagcagtgtgtgtgcgcgcgcaagagagagagactgtgagtctgggagtagccctctcccctcctttggccatcttcctcgtgtatatgcatatatgcatcatcgcaacggtgtatatttgtggtgtggcgggtgtggcattggattgcccccattttggctcgtgcttcccagttagggtaaaacctgtggtaaacttgctagccccacgccaaagttacccttctttattgttgaaagggagaggaggtgtgtgaattgtgatggagggagagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgagtcgacgaggggaagagttgagctgaggcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccatcaggggagccccttctggtattaagatctttccggcacattgattttcatactttgtgatgaccctggaagaatcggcgtagcagcgtagcaccgctccattttggtcttaccctcacctccccatgctatgaactgatcaatttcattgttcttcatcacccttctcctagctttccacttccttcggatctcatgccatgtttctcagcatgaatcaaatttaattcgtgttttctacttccatatatactggaagaaatttaattagatctatttttgctcgggaggtcttcatactttgagttctgatgccatcaccttatttcccccccccccttctcttgttctatcttcttcctcatcttggcttgatcattttgatctgtcagttatagcatgatgcattctcaatttgactgtatgtaagttcaaccggaaatatgttgaatggattttctatatatcaacacttgatgtcaggcctgcatctgtttcgcttgtggtggtgtggccaaaattgtctatatttgatctttgctcttctttctcctcatttcatgacgattcctactacggcttaaaccattctttattctttactaatcatggatgttgcttgactcctagttgtttcgtactagctcaacttggagatcttttcattatttgcctagttggtgggtacgtttgtgacagatctaaaatggtgcacgaaaagttttacttattatgaaaaaagggagcttaacagggtaatttctctatttattcgtgatgacattttttccttgataagggggattttttataatctgcactcacatgtttatatgtaaaatctagctcttttgttttgtttttggcatatttcccgctaagtatagagtttatgtggataacattataacttttcaagatccaatccacatctttgattgtgaaaatcatacaatagggaaaatcaactgaagggttaattagatgctatatgcatatatatatatatgtgcgcgcgcgcgcgcctgaatttaactatgtatgcatccaactgtttcattgaaaaagatttgatatttttcagtctattctttttcgagtatatatttaatatgtttcaatctgttttgaccattataagataaagcctatattcaccaggcatttgagatgatcttttcatgcatgaaaaagctgttgttatcacttcaactaaccagacgatctaacatgtatttgtataagaaacagaccttgatttccttctgtaaaatcatgcatgtgttcgttttgaattggagtcggcgcgcctgtgttttgaccgtcaggaaagtcttttttttccctgaatagtcaagggtctatacttcttgaagcaattgggacactaatcaattattgtttatacctcggaccatcttttccttcttcacaccactaatcagtttatgccttggaccattaattgtgttgttcacaagcttcttgtttatggtttacaaagcattcgcctagatttgtgtgtgtctctacacatcgatcacttttaaatacttgtcgctttcagttattcttttaacgtttggttatttatcttatttaaaaaaattatcgtattattatttattttgtttgtgatttactttattatcaaaagtatttcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgcagcataaccaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatcaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgcactagtcccacgtgagctcgctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagtcgttttaactttagtcaaagttaaactgtttcaagtttaaccaagtttgtagataaaagtagtaacatattcaacacaagacaaatatattataaaaacatattgaattatagatttaattaaattaatttggtattgcaagtattactaaatttgtttataaatttggtcgaatttaaaatagtttgactttaaccaaagtcaaaacaaattataatctaaaacaaaggtaatacattgtatcactctcatgaatggattgtaacatacattaatttaattactattttagttcttgtgcaaaagttgaaaacgatttatgtttggaatctttttgtggtgtatatatatgaaaccattcctctaccatccttccccaaccataatcctcacaaccgttagccccattgtgatctcacccagttgctagcctcttttgtcaccttgtcacagctctcctccattcattacacaatggcatcggaccg

SEQ ID NO: 538 - DNA, 9487 bp, Artificial sequence
  OsMADS8-GUS expression cassette
  misc_feature (1)..(9487): OsMADS8-GUS expression cassette
cggaccgttttttgcgaaatgccaaatcctggcatgcctaagctgacctgagcttgtagttttcaaacgaaccgtgttaattgtggtatataacacattgggttggctactgtatcgtacataattttgttggggttatttctgcatgcgtatacgtacggattagttgtaattaagaggaaaaacatgcatgtataatatagatatacctagcatgcaccattatatacttattaatctaagctttaaagtgcaaatgatactacatattgaacattcaactttattgtattgataaattgaaccggatatatccacaagcacaaaatttgcaatgcacttcaaaattaatgtaatctttgcacgctactccctacatttcatattataagttgatttgactttttttttcaagtttataaaaaaaattagcaacatctaaaatatcaaattagtttcacttaatctaacattgaatatatttagatactacgtttgttttatcttaaaaatgttagtatgttttttttataaacttggtcagcctttgaaatgttggactagaaaaaaaggtaaaaaaaattataatgctgaataagccacaatttaaaaagtttacagggacggtttaattcattgacatttcacatatacatagcacatgtcaaattcatatgttaacttttctttttataaactggacaccccgtgccaacagtcaacccctaattaaattaaccacaacatgaatacatcattaattttataacatatactagttattttgcttttcatatatctccccctcttgctaatttgagttcccagcatgcatggatactaattaacttaaccaaaattagttagcctgcagcctaatttgtccatctctagctagctagtttgcacttaacatctgtgatacgttaccacaccaaagttacatacacattaatgattaatcctttgatcagttcctatatatcccaggtagaatatatatcgatctcttcagaatcacgaccaattaggtaaaatgaaagaacatacactcctgcctagccaagacttcaaaccttacacacacatatatatctactactgcaagcactgcaacggcaaagttctctgcaggcaaagagatataccgatcgaagaagcctctctctatccaaacccaaacagctccattttgtctacacgaactatggcaacttggcaaccacatcgctagctagctagatatatactatgctaccttggttcattttgctgctttgatttgcaactgcaacccaagagaaaagttgtaagggtctgtatggggattttctgaccgctgtatcttctctcaaaatcatattaatcctctctacatagtctagtttttcatccaaattctcaaaagctctaattatagaatctaaaaaattaactagaaaacagaagctgagaaatccacattctccatattctcagaagcttgatactaactagctatttcccaaaatcttaggccttatttagttggggaaaatttttgggtttgtttgtcacattggatatacggacacacattagtattaaatgtggtacaataacaaaacaaattacagattccgtcaaaaaactgcaagacaaatttattgagctcaattaatccgtcattagcaaatgtttactgcagcaccacattgtcaaatcaggcgcaattagacttaaaagattcgtctcgtaatttacacgcaaattgtgtaactggttttttttccacatttaatactccatgcatgtatttaaatattcgatgtgatgggtgaaaattgtttattttggaaactaaacaaagccttaagctctcccaacagatcacccaccggctcctagtggacacaagaagggtatttttcccgaaacccgaaaactccgaggtttcaagtgcaaaagcgcccaactctactcacttttccccagcttttccgcgcttaatttctcgacctgtcgaatcctcagtcgccaccgctgcgtcgacgaggagagagagagagagagagagagagagagaaaatccaaagcaatcagtgagagacgcattgaattgggtcggagattagtgcgaaattaacctagatagctttgcctttgcgtacgatggatcgatcgaggccgcctagggttccgcgtcgttccaccaccttgccggaaatggcaatgccgggtagcccccaccgccgctgcccaccctctcccccttccctttttaaacccctcatccccttccccctcctcctcctcctcctcgccttagctttcccctctctttcgcttcgcgagattggttgattcatctcgcgattgatcgagctcgagcggcggtgaggtgaggtggaggaggaggaggaggagatcgggtcgacgagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaaggtatatatacatggacgcactgggcgcgcgcctcgatctgctatagctagatcggtagctgcttgcaacgtagctagctagggtttcttgcgcgcgcctgcgcctccagatctggagcgcacgatggttttgtgaacttcttggtggcgattttgcggggatctggggctgcacatggtggatctgcgagtgtgctcgtgttttggtgagttttgggagggtttgggagaaggaagttggtggaattctgtgggaataattagggtttttgttcgttcgatcgggtgctagctagcgtaatagggagtggtgaaatacgtagatctgagggtttctgatcccgtggtagtagtggttttgagatggcgcgcttaatggttttgagtttggtttaattgcgattaatttatgtgcatgcatgggatgggacattcaggatttaagcctggatcagcaagtcgatttttacggagaaaattaatcgttggaagcttcgaatcttaattttatcgatctcctaatggagggtatgcgagtttcgaattcccttgggatctgtttttttcctcaatttttagttttttgaggggcaattttttttagggtatatatgattttttttttttgggggggggggggtgtgtgaagggatcatgcatatcattagccatgtaccggatgtgtgtctaaacaaacgttcactgcatgaattccacggtttggaggcagcataccttacaagatttgggggtttcacttaagattttgtctctttgtttttttaagggatggccgcgggggagtattgtttttcaagtgagttatggttgcatcattaaaggcaacatcaataaatataaagtctgtttctcctgagataagtatatgaaaaatcatatactactatatatataattgtctttcagaaacacagagcgtctgattggctaggcataattcacaagccgcatataagctagttgaattgattttgaattagaaaacattttttttcggggggaagaaaacatttggtattgtgtttagagataaacaattagttagggtagataagtcaggcattcatgagcttcatttcatatttgaatcatacattttccaaactttagaaggttaaattttcttgctcattgtattgcactgatcattttaataatatcttctatagtgaatattacatcattatatattttagataatgattacattattatatgctccgttgcagaaaaaaccaacttttttgccaaacctggacatatataggctatgtccagatttatagctagaagttagggcctcatcttttaccctatgaattataagccaatatcaaattttgaatttcgaaacttgatttagaagttgatttttaatgttttgtcaatgtagattgtttttcagcattaacttttaattcgctaaagacacatatacaattttactcacaaattatattttggttgctaataagccgttatggcttataatcagccgtaagtatatggggactttagcattctttttctttttttatggagggagtacatgcttgccaatttttatagttatgtttaaatggtttccattatacctaagttactaaattaaaattaatacgcctataaaattctaacattaaatatattcacaaataagagtacatgatttcattgaccagggaattcaatttggatatggggtgagtgaaacatccctcctctgctcctcggaagaaatcctgcaagggagtacacaatattcctaggactcacttgagtatctgcagggtacagttagtgacagctttcgattgtcattcgattggtctcctcagctctcgtagctgagctgtcagtacagaagattggtcttcatcagatgtctcttctagttctagctagagctagttcagtggagtattttatgccgacaaattgatactcaacgtgtactgtagatccttttcagaaatctgaattcacgacttgtttaaacaaaggctgtgtttggatccaaacttcagtccttttccattacatcaacctgtcatatacacacaacattttagtcatatcatctccaatttcaaccaaaatctaaactttgcgttgaactaaacacagccaaaaggtcactaaattgacgcggtagaggggggggggtgagcattatagctgtagtagtagtctgcgtgaagttatgccatttcattgtgtgtcgtctgaacttgatatctctctttaaagagtgtactccattttctttacaaaaagtggcctctaggttgatatcatggacatatataaaattataaatcaacttgaaactaccgatgcaagaattaagataaaacgttattgtttcttagaaattgtctccaattatgcaagcaccttcatccgtgtcatggagctaatgttcatgttttgtgggaaacaagatttttcatctactaattaatcgatgtggtccccggaaaagaatgtgccctagattgttagtatttagttatgggcgaactatatatgttcctttatttcgtttttccataaacatagccatttgtgtttttgaaacttgcagcttgaccaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatcaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgcaggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattaccatgctcatgtgcattctaggttctttatatataggagtattaggttaactgattagttgttgtacatcattgtctaaaaaaatagctgtcgttgtacataaattgagcatgctggtctgcatgaaaattaaggaaaagaaacatgcaagtagcccaggtagttgggctgtcaagcagtcgtacttgtccgagtcgcagatagttagttgacccgaaactgtgattgcgaacgtacgagcgaaaatgtagatgcaggcatttcaacttgagtgatttgctttttattcatatatatggttcattttttttaaagatggcttcgactggatctcgtcttcgttaagcatgcgtccaggaccaggagtacatgcattttgcattcagccctaaccaatactttttaccaattaaagagcagagcaggcacgacacgcatagacaacggacatggatcttcgcagtactacatttgcagtagcagtggctgataggtgaacccgatcctacatgtcagtggctgctactgtagacaatctccactgatagacaacgggtacaactcgtagtattaattcaaacgccaaatgcattaatggtagtttgcttattagtactagtttgcataacgaagcgtgtatatatatttatacttcctccgttttatgttttaatttggacttgtcgttccagaaaatcgtacgaagtcatagcaaattacattgcaattcttcttaattacatattaatcatgttttcaaagtaagaattagaattccttataagagactactactagcatggttgtgttagagaaaggtaagaagaaaaaagcatttaaaaagtgatttggaatatgagaatgacaagtgttttggcataacttttaaatggtagaacgacaagtaatttaaaacatacaaagtactagtcccttcatttcatattataattcgcttcgactttttctaagtcaaacattgttaaatttgactaggttttatagaagaaaagtaacattttaaacgtcaaattagtttcattaaatctagcatttgaatatattttgataatatgtttgttttgtggtaaaaatactattatatttttctacaaatctagtcaaacgtaaaaaaaaagtttgactaggaaaaaagtcaaaacgatttataatataaaacataagagcacccgcaatagtaaagtaaggtgctctctgtaaaacatgtacatctcagcaatagactagattaatagtaaaccaccttaatagtatgtctacttgggtatctatagctctctaatatattgcctcgtttttctctatagactatcttcacattagtagatagctttgctctcttttttcatctcttccaagtaggaaaatatgctgacatggatctcttgtagagagtttatagataaccattgtgggtgccctaagtagtactatcttttcttcctgtccaaaaaatataaagcacttttgagcttctatacgtagatttaaatgagaaatggctatatttgattgagataagtgagtaggtaaacgctctatttaagataaattgtaaagttaatatattttgacggaggggaagtagcatttatgaaaccctagtagagctacgcttcgttgaccacactcctcgaaataaacatgatattttgtcatgatcgatgactcggaccg

SEQ ID NO: 539 - DNA, 5286 bp, Artificial sequence
  OsMADS13-GUS expression cassette
  misc_feature (1)..(5286): OsMADS13-GUS expression cassette
cggaccgttccaaaattaagcacacacatttgcaagaactagctaggcatgcatatatgataattaaccggcaagttgacttcagttattctgcagatgtactaaacacataacaagggatgatcagttgcttatttttttcataacttgctaggttgcttataactccagccttctggacatcgaccaatctctaaacatactttagcagtgcctacaaagtacaaacaactaaatacctctctgcagatcagtgtttctaggcacaaattacacaagatagaaaaaaggagaggttataaattcttgcttaaagaatatacatgtaaagatgtctaaatagctataaatgggtaagcaagatagcaaagaaggccagtggcctttgcagctaagctagctagctagcccttcttcctctctttcctgctttccctttgccttctcctattaatcctctgcacctcacacagcagcagaaaacccaccaactggagctctcctttcctactccaagaaacgaaggtagagaaagaaagatcagatcagcttcaggaccaattttagctaggttatatatctctttgcgtgctaatgtgttttagttatctgggtgtgtgtagagttctttgttaaggcactgattcagctgcagtttagattcaagtttgtatgttctctctttgaggaaaagaaacccttttcctgtgcttcgagttcttgcaaagagaaactgtgatgcttggcttccagtttgatgcttctttgttcagattggaaattcttcctagcttctttctctatttatgtagcaaggattctttccggcccagtgatcctggtttcttttggaaggtttcagttttttcgttctttcttgaaatttctcttcttgccttaggcagatctttgatcttgtgaggagacaggagaaaaggaagaagctagtttcctgcggccgacctcttgcttctcactttgtgatgagttttctttggtcaattcttagctagatatgctaagatagttagttaagcaaatcgaaattgctagcttttccatgctttcttaaacatgattcttcagatttggttggttcttttttttcctttttgtggagacgtgctgttcttgcatcttatccttcttgattcatctacccatctggttctttgagctttctttttcgcttcttcccttcattatttcgagcaatctctgcacatctgaaagttttgtttcttgagactacttttgctagatcttgtttactcgatcactctatacttgcatctaggctcctttctaaataggcgatgattgagctttgcttatgtcaaatgatgggatagatattgtcccagtctccaaatttgatccatatccgccaagtctttcatcatctttttctttcttttttatgagcaaaaatcatctttttctttcaaagttcagcttttttctcttgttttacccctctttagctatagctggtttcttattccttttggatttacatgtataaaacatgcttgaatttgttagatcgatcactttatacacatactatgtgaatcacgatctcagatctctcagtatagttgaattcattaatttcttagatcgatcagcgtgtgatgtagtactgtaaatcactactagatctttcatcagtctcttttctgcatctatcaatttctcatgcaagttttagttgtttctttaatccggtctctctctcttttttaatcagctgagagtttgtgctgttctttaatcattaccagatctttcatcagtactctctcttctgcatctatcaaacttctcatgcaatgtttttgctgttctttgatctgatctctggtctccttttttgttgatcagttgagagcaagaagccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtaccaagctgcgaatcttcgtttttttaaggaattctcgatctttatggtgtataggctctgggttttctgttttttgtatctcttaggattttgtaaattccagatctttctatggccacttagtagtatatttcaaaaattctccaatcgagttcttcattcgcattttcagtcattttctcttcgacgttgtttttaagcctgggtattactcctatttagttgaactctgcagcaatcttagaaaattagggttttgaggtttcgatttctctaggtaaccgatctattgcattcatctgaatttctgcatatatgtcttagatttctgataagcttacgatacgttaggtgtaattgaagtttatttttcaagagtgttattttttgtttctgaatttttcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatcaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgagagctccgcgggcggccgctgacatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgcatgcatgcatgcttaattgtgtcacctttggggattcattttgtacatatgtgcaccattttgtgtgtacaatgcaggtttatatgacttttttcgcaattacacgatggcccatgcacataaccaccatgcacactgcacgtacatccacaagtgtgcccctttaacacaaggcaatacaccaaataaattgtaatgtgccactaaacttttttgaaagtgtaaccgcgcgtatgcttccgtggcttatatatgactctggtggctgacttctagggcatgtcgacctgagcatcttcgtgtgggtttcgactctctaattctcctggtctctggcagttgtggaaggggcgaaactccagggtttttgattactctctttcctcactctcaagggttctgaaagtcatcctacaggaagaccgtttgtggtcttctgctggcgtcgctgtttttaggggtttattaggagtgtagtggagcttcgccaccaccctccatctatttaggagcaacatttttttggtagttttttactttagcagtctttttgtttctttctttgttcccttatccacatgcaatggtcgtctgactggttacgttgtgtaacaaaaactctgcttttttctaatatactgacgtgcaatcctttggtgcgttcgcgaaaagaaagggggatcaattgcaagtattttgtgggaattaaacttttcttgtgaaattattgtaaaattccagcattctaaatgagctctaatgtgtgataatttgcattctctatatatattgaataattcttttgttgactagttgggtgcccgtgcgttgcggaccg

SEQ ID NO: 540 - protein, 380 aa, Zea mays
DLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVYEKLGESVKDIDGARMEDNKFCVSVHYRNVAEDDYKKVFHRVTAVLEGYPCLRLTHGRKVFEVRPVIDWNKGKAVEFLLESLGLSESEDVLPIYVGDDRTDEDAFKVLKASNRGFGILVSSIPKESDAFYSLRDPAEVMEFLRMLAAWKEQST

SEQ ID NO: 541 - protein, 416 aa, Oryza sativa
AMNQYEPEQNPIVYLLALVLLVTVLTTTLRRVLLMDLKTSNSPVIADPLPKLALPSAVMTYTTPTSFPSTGLYLNTPKKKPLPGKIEEVRAAGWLDLMLASSPPRKRQTKDFANDVQADELDLLYRNWVVNHPSALTSFEDIVNLARGKRLALFLDYDGTLSPIVDNPENAVMSDEMRSAVKHVASLFPTAIISGRSRDKVFDFVKLTELYYAGSHGMDIMGPVRKSDSSGQHVECIRSTDSEGKEVNLFQPASEFLPMISEVYKKLSESIKDIDGARMEDNKFCVSVHYRNVAPHDYGEVHQRVTAVLKNYPCLRLTHGRKVLEVRPVIDWNKGKAVEFLLESLGLCGKEDVLPIYVGDDKTDEDAFKVLKANSIGFGILVSSVPKDTDAFYSVRDPAEVMEFLKKLASWKEEST

SEQ ID NO: 542 - protein, 368 aa, Zea mays
DMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 543 - protein, 384 aa, Arabidopsis thaliana
DMKSGHSSPVMTDSPPISNSRLTIRQNRLPYSSAAATAISQNNNLLLTVPRKKTGILDDVKSNGWLDAMKSSSPPPTILNKDNLSNDATDMTYREWMQLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 544 - protein, 291 aa, Zea mays
GTRSRAAADVDELTAWMRKHPSALGKFEQIASASQGKKVVMFLDYDGTLAPIVADPDAAYMSDVMRAAVRDVAKHFPTAIVSGRCRDKVRSFVDLSELYYAGSHGMDIEGPSSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFASCSDALPVYIGDDRTDEDAFKVLRKRGQGVGILVSKCPKETNASYSLQDPGEVMDFLLRLVEWKRKSTTTRPP

SEQ ID NO: 545 - protein, 366 aa, Oryza sativa
TNQDVVVSEMGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIEWDKGKALEFLLESLGFANCGDVMPVYIGDDRTDEDAFKVLRKRGQGLGILVSKCPKDTNASYSLQDPTEVMEFLLRLVEWKRKSSSSSLMIRPRV

SEQ ID NO: 546 - protein, 373 aa, Arabidopsis thaliana
TNQNVIVSDRKPILGLKTITVSVSNSPLFSNSFPTYFNFPRRKLLKLLEAADKNNLVVAPKITSMIDSMRDSSPTRLRSSSYDSDSDNDDKTSWIVRFPSALNMFDEIVNAAKGKQIVMFLDYDGTLSPIVEDPDKAFITHEMREVVKDVASNFPTAIVTGRSIEKVRSFVQVNEIYYAGSHGMDIEGPTNENSNGQSNERVLFQPAREFLPMIEKVVNILEEKTKWIPGAMVENNKFCLSVHFRRVDEKRWPALAEVVKSVLIDYPKLKLTQGRKVLEIRPTIKWDKGQALNFLLKSLGYENSDDVVPVYIGDDRTDEDAFKVLRERGQGFGILVSKVPKDTNASYSLQDPSQVNKFLERLVEWKRKTVGEE

The invention claimed is:

1. An expression cassette for expression of a nucleic acid molecule comprising:
   a. a promoter, first exon, a first intron, and a second exon of a MADS gene obtained from *Oryza sativa*, wherein said promoter, first exon, intron and second exon are the 5'-regulatory sequence of said expression cassette; wherein said 5'-regulatory sequence has been engineered to include a translational initiation codon at the 3' end of said 5'-regulatory sequence, and not to contain restriction endonuclease sites that hinder manipulation by recombinant DNA methods or additional translation initiation codons upstream of said translation initiation codon;
   b. a 3'-regulatory sequence of a MADS gene obtained from *Oryza sativa*; and
   c. a nucleic acid molecule operably linked to said 5'-regulatory sequence and said 3'-regulatory sequence, wherein said nucleic acid molecule is heterologous to the 5'-regulatory sequence and to the 3'-regulatory sequence, wherein the product of the expression of said nucleic acid molecule is targeted to the reproductive tissue of a plant.

2. The expression cassette of claim 1, wherein the product of said nucleic acid molecule when expressed in a plant makes said plant abiotic stress tolerant.

3. The expression cassette of claim 1, wherein expression in a plant results in an increase in the sink strength in said reproductive tissue of said plant compared to the sink strength in the reproductive tissue of a plant not comprising the expression cassette of claim 1.

4. The expression cassette of claim 3, wherein said nucleic acid is a nucleic acid encoding a trehalose-6-phosphate phosphatase protein.

5. The expression cassette of claim 1, wherein said nucleic acid molecule is depicted by SEQ ID NO. 531.

6. The expression cassette of claim 1, wherein said nucleic acid molecule encodes the amino acid sequence set forth in SEQ ID NO. 532.

7. The expression cassette of claim 1, wherein said expression cassette is depicted by SEQ ID NO. 536, 537, 538 or 539.

8. A recombinant vector comprising the expression cassette of claim 1.

9. A transgenic plant cell comprising the expression cassette of claim 1.

10. A transgenic plant comprising the transgenic plant cell of claim 9.

11. A transgenic plant according to claim 10, wherein said plant is a monocot plant.

12. A transgenic plant according to claim 10, wherein said plant is a maize plant.

13. A transgenic plant according to claim 10, wherein said plant is a rice plant.

14. A transgenic seed from the plant of claim 10.

15. A transgenic seed from the plant of claim 11.

16. A transgenic seed from the plant of claim 12.

17. A transgenic seed from the plant of claim 13.

18. Plants containing the expression cassette according to claim 1.

19. A method of targeting a nucleic acid molecule to the reproductive tissue of a plant comprising the steps of introducing into said plant an expression cassette comprising:
  a. a promoter, a first exon, a first intron, and a second exon of a MADS gene obtained from *Oryza sativa*, wherein said promoter, first exon, intron, and second exon are the 5'-regulatory sequence of said expression cassette; wherein said 5'-regulatory sequence has been engineered to include a translational initiation codon at the 3' end of said 5'-regulatory sequence, and not to contain restriction endonuclease sites that hinder manipulation by recombinant DNA methods or additional translation initiation codons upstream of said translation initiation codon;
  b. a 3'-regulatory sequence of a MADS gene obtained from *Oryza sativa*; and
  c) said nucleic acid molecule operably linked to said 5'-regulatory sequence and said 3'-regulatory sequence, wherein said nucleic acid molecule is heterologous to the 5'-regulatory sequence and to the 3'-regulatory sequence, wherein the product of the expression of said nucleic acid molecule is targeted to the reproductive tissue of a plant; and expressing said cassette in said plant.

* * * * *

UNITED STATES PATENT AND TRADEMARK OFFICE
CERTIFICATE OF CORRECTION

PATENT NO. : 8,129,588 B2
APPLICATION NO. : 11/109594
DATED : March 6, 2012
INVENTOR(S) : Nuccio et al.

It is certified that error appears in the above-identified patent and that said Letters Patent is hereby corrected as shown below:

In the Patent:
Column 1, Reference To Material Submitted On Compact Disc, Lines 8-16:
    Please replace paragraph in its entirety with the following:

-- The Sequence Listing associated with the instant disclosure has been submitted as a 1.04 MB file on CD-R (in duplicate) instead of paper. Each CD-R is marked in indelible ink to identify the Applicants, Title, File Name (70369USNP.ST25.txt), Creation Date (August 14, 2006), Computer System (IBM-PC/MS-DOS/MS-Windows), and Docket No. (70369USNP). The Sequence Listing submitted on CD-R is hereby incorporated by reference into the instant disclosure. --

Columns 13-28, Table 2: In order to correct errors found throughout Table 2, please replace Table 2 in its entirety with the following:

TABLE 2
Primers for constructing expression cassettes comprising regulatory sequences from the MADS gene family

| target gene | primers to clone 5'-regulatory sequence | |
|---|---|---|
| | name | sequence |

Signed and Sealed this
Tenth Day of July, 2012

David J. Kappos
*Director of the United States Patent and Trademark Office*

| | | |
|---|---|---|
| AB003322 | AB003322-1 (SEQ. ID No. 133) | 5'-CGTTGCCCAGCGAGGAGCATGCGTAAAATC-3' |
| | AB003322-2 (SEQ. ID No. 134) | 5'-GATTTCATTCATACTGTCCAACAGAAGGCA-3' |
| AB003324 | AB003324-1 (SEQ. ID No. 145) | 5'-TCTAAATAGGGCCCAACATACTCA-3' |
| | AB003324-2 (SEQ. ID No. 146) | 5'-TCAAGCGTCTTAAGCATGCTGAAATATGA-3' |
| AB003328 | AB003328-1 (SEQ. ID No. 158) | 5'-AACAAAACCAATAATCTCCAATGCCC-3' |
| | AB003328-2 (SEQ. ID No. 158) | 5'-CATCTTCGATCGCCGATGAACCAACC-3' |
| AB077760 | AB077760-1 (SEQ. ID No. 167) | 5'-ATTCGTTGGGGGTGACATGACTAGTC-3' |
| | AB077760-2 (SEQ. ID No. 168) | 5'-CAAAGATCCCCTTGATGCTGCAGCAG-3' |
| AB095645 | AB095645-1 (SEQ. ID No. 179) | 5'-CTCGTCGCCGTCGTTGGCTCGGCGT-3' |
| | AB095645-2 (SEQ. ID No. 180) | 5'-CAAGATTCTTGATAGCCTTATACATG-3' |
| AF139664 | AF139664-1 (SEQ. ID No. 193) | 5'-TGCATCCTTACAAAGAGACAGATAGATC-3' |
| | AF139664-2 (SEQ. ID No. 194) | 5'-CAAGGATTTTGTCCATACTGTGAAAAATG-3' |
| AF139665 | AF139665-1 (SEQ. ID No. 207) | 5'-ACCTGGGGTTTGGAAATGGGGAGCG-3' |
| | AF139665-2 (SEQ. ID No. 208) | 5'-CAAGGATCCCTTCCATACTACAGAAGAAG-3' |
| AF141964 | AF141964-1 (SEQ. ID No. 218) | 5'-AAAACACTGATTAAAGGGTTGTTGAAAGGAAAACACC-3' |
| | AF141964-2 (SEQ. ID No. 219) | 5'-CATAGGTACCTTCAATGCTGAAAAAGAAAACAAGGCA-3' |
| AF141965 | AF141965-1 (SEQ. ID No. 232) | 5'-TGTTTCTCGATTAGGCTACAAGTTAAC-3' |
| | AF141965-2 (SEQ. ID No. 233) | 5'-GATGGTTTTCTGTAGGCTGCAGAACAG-3' |
| AF174093 | AF174093-1 (SEQ. ID No. 246) | 5'-AAAATTCACAAGTATAATTCGTCAC-3' |
| | AF174093-2 (SEQ. ID No. 247) | 5'-CAGCTCCATCAAGCTTAACAAAGCA-3' |
| AF204063 | AF204063-1 (SEQ. ID No. 258) | 5'-ACAAATTTGTTGTACCACCTACCTAGGGGT-3' |
| | AF204063-2 (SEQ. ID No. 259) | 5'-CAAGGTTTTGTACATGCTGGAAGTGAA-3' |
| AF345911 | AF345911-1 (SEQ. ID No. 271) | 5'-GAAAATCTCAAGGTTTCGAAAACGAC-3' |
| | AF345911-2 (SEQ. ID No. 272) | 5'-CAAGGATTTTGTCCATCCTGCAGGGAAAAC-3' |
| AF424549 | AF424549-1 (SEQ. ID No. 283) | 5'-TACAAAGTGCTGGAAGTGATAGTATGT-3' |
| | AF424549-2 (SEQ. ID No. 284) | 5'-GATCCCCTTGATGCTGCAGCAGGATGCA-3' |

| AJ293816 | AJ293816-1 (SEQ. ID No. 295) | 5'-CAAACATTTTAAACTTTAACCATTAATAG-3' |
|---|---|---|
| | AJ293816-2 (SEQ. ID No. 296) | 5'-CAATAATCTGTTCCATGCTTCATCAATG-3' |
| AY115556 | AY115556-1 (SEQ. ID No. 305) | 5'-GATATAAAAACCTACTTTATGTTCATG-3' |
| | AY115556-2 (SEQ. ID No. 306) | 5'-CAGCTCCTCCATGGTTCTGTTCAAAGAAATC-3' |
| AY177695 | AY177695-1 (SEQ. ID No. 316) | 5'-TCAGTCCATCATTTCGTCTACAACTAA-3' |
| | AY177695-2 (SEQ. ID No. 317) | 5'-TATTATTGATTTCATGCTAACAAAAAG-3' |
| AY177696 | AY177696-1 (SEQ. ID No. 330) | 5'-CAAGCAAAGAAACAAATTTCGCAATTAG-3' |
| | AY177696-2 (SEQ. ID No. 331) | 5'-ATAACTGACTTCATGCTGCATATTTGCA-3' |
| AY177698 | AY177698-1 (SEQ. ID No. 342) | 5'-AAGATTTGAACTACTGCCTTGTCTTC-3' |
| | AY177698-2 (SEQ. ID No. 343) | 5'-CAAAGATATTTGCAATCCTGCCAAAAG-3' |
| AY177699 | AY177699-1 (SEQ. ID No. 356) | 5'-TCCGGTCGGCCCTCGTCCTCCCCGT-3' |
| | AY177699-2 (SEQ. ID No. 357) | 5'-CAAACTCCCTCACGCTGCGCCAAGAAAG-3' |
| AY177700 | AY177700-1 (SEQ. ID No. 366) | 5'-ATAAGTATTTCAGAAAGCTGAAGTTGA-3' |
| | AY177700-2 (SEQ. ID No. 367) | 5'-CAAGTTATGCATATTTCTTGCATTTTG-3' |
| AY177702 | AY177702-1 (SEQ. ID No. 379) | 5'-TCTTTTCGCAAACTAAACAAGGCCT-3' |
| | AY177702-2 (SEQ. ID No. 380) | 5'-CACAGTTTTCATGCTAGCATGCAAGTAAAG-3' |
| AY224482 | AY224482-1 (SEQ. ID No. 392) | 5'-TCTTTTCGCAAACTAAACAAGGCCTTAACA-3' |
| | AY224482-2 (SEQ. ID No. 393) | 5'-TATCACAGTTTTCATGCTAGCATGCAAGT-3' |
| AY250075 | AY250075-1 (SEQ. ID No. 405) | 5'-GAAATGGTTTCATTTTGGGACAAGTTATTG-3' |
| | AY250075-2 (SEQ. ID No. 406) | 5'-CAAGGATTCGCTCCATACTATCAATAAAATATG-3' |
| L37527 | L37527-1 (SEQ. ID No. 419) | 5'-GCCAAGAGAGCCCCCTTGCTGCTGGT-3' |
| | L37527-2 (SEQ. ID No. 420) | 5'-CAAGATCCTTGACAGCCTAAAACGCCA-3' |
| L37528 | L37528-1 (SEQ. ID No. 432) | 5'-ACCACCTCAATCTCCACTGTTTGATTG-3' |
| | L37528-2 (SEQ. ID No. 433) | 5'-CAGCTCAGATCGGTCTGGACACAAAC-3' |
| U78891 | U78891-1 (SEQ. ID No. 443) | 5'-TCTTCTTCTTGCCTTCATTTGAGTTAATTACA-3' |

| | | |
|---|---|---|
| | U78891-2 (SEQ. ID No. 444) | 5'-CAAGCGTTTTAGTCATGCTACAAAGTTC-3' |
| | AF095646-1 (SEQ ID No. 508) | 5'-TGTTGCATGCATGCGTACTGGTGATGGCCGCA-3' |
| | AF095646-2 (SEQ ID No. 509) | 5'-AATGTCTTGTTTATTCTGCAAACAAAAATAGG-3' |

| primers to clone 3'-regulatory sequence | |
|---|---|
| name | sequence |
| AB003322-3 (SEQ. ID No. 135) | 5'-TAACTGAAAGGAAAAAAAAAGCATCCTTGC-3' |
| AB003322-4 (SEQ. ID No. 136) | 5'-GAATAAATCTGGCAACTGAAATCCAACCAT-3' |
| AB003324-3 (SEQ. ID No. 147) | 5'-CTAGCTAGCTAGCTACCGTTTCAGCTTC-3' |
| AB003324-4 (SEQ. ID No. 148) | 5'-TGGAGATCGACCACAATTAAATTCGT-3' |
| AB003328-3 (SEQ. ID No. 160) | 5'-TAAGTAACAGGCCAGGAATAAGCTGG-3' |
| AB003328-4 (SEQ. ID No. 161) | 5'-ATTGCCGGCTATAGCCTTTCTCCCT-3' |
| AB077760-3 (SEQ. ID No. 169) | 5'- TGATATATCATCGCCGCCGCCGCCG-3' |
| AB077760-4 (SEQ. ID No. 170) | 5'- CCGTGGTACTGAAATCGAAAAAGAAATG-3' |
| AB095645-3 (SEQ. ID No. 181) | 5'-TAAGCTGCTAGGTTGCCCCGCCACT-3' |
| AB095645-4 (SEQ. ID No. 182) | 5'-GCACGGCTACCTCTCGCCGGAGTACG-3' |
| AF139664-3 (SEQ. ID No. 195) | 5'-TAAGGAGGCTTCAGATCCATACCAG-3' |
| AF139664-4 (SEQ. ID No. 196) | 5'-GGATAAACATTGTGAAGCAACATTTC-3' |
| AF139665-3 (SEQ. ID No. 209) | 5'- TGAAGGCATCTGTTGATCTCAAACGTC-3' |
| AF139665-4 (SEQ. ID No. 210) | 5'- ATGAACTCCACCTCGGGAACTCAGCCT-3' |
| AF141964-3 (SEQ. ID No. 220) | 5'-TGAGCAGGAAGCACAGGTGTCCTGT-3' |
| AF141964-4 (SEQ. ID No. 221) | 5'-ATGAGATACAATCTAGTACAACGAAT-3' |
| AF141965-3 (SEQ. ID No. 234) | 5'-TGAAGAAGGCCAGCCACAGCAACAGCTG-3' |
| AF141965-4 (SEQ. ID No. 235) | 5'-CCTTATCGAATATTCAAATCTCGATG-3' |
| AF174093-3 (SEQ. ID No. 248) | 5'-TGACTTCCTGGAAGCAGTAGGAAC-3' |
| AF174093-4 (SEQ. ID No. 249) | 5'-CCCCTTCTCCTCCTCCGGGAAGAAG-3' |
| AF204063-3 (SEQ. ID No. 260) | 5'-TGATGTGTGTGTTCAGTTCAGGCTT-3' |

| | |
|---|---|
| AF204063-4 (SEQ. ID No. 261) | 5'-CTGCATATACTTGCAACATTGCAATTTTA-3' |
| AF345911-3 (SEQ. ID No. 273) | 5'-TAAGATGATCATCGTCGTCGTCGTCG-3' |
| AF345911-4 (SEQ. ID No. 274) | 5'-TTGACTTAAATGGCAAGATAAATTAGATATAG-3' |
| AF424549-3 (SEQ. ID No. 285) | 5'-TGAGATATCGCCGCCGCCGCCGCCG-3' |
| AF424549-4 (SEQ. ID No. 286) | 5'-TTTTATTATCTTGGCGAGGCCCAAGCACCTTTG-3' |
| AJ293816-3 (SEQ. ID No. 297) | 5'-TGATGGCTGGAAACTAAAACTGAGAGGA-3' |
| AJ293816-4 (SEQ ID No. 298) | 5'-TTTGAAACATTTCGGCCCTGGCTCTCCT-3' |
| AY115556-3 (SEQ. ID No. 307) | 5'-TAACACTAATAATGGCCTGGGGGATAC-3' |
| AY115556-4 (SEQ. ID No. 308) | 5'-AACTTTGCACGAATGATTAAATTGCAT-3' |
| AY177695-3 (SEQ. ID No. 318) | 5'-TAACACATGATCAAGTGTTAAAAACAG-3' |
| AY177695-4 (SEQ. ID No. 319) | 5'-GGCTCGGTCAAACCAGCGTGGTGAGCT-3' |
| AY177696-3 (SEQ. ID No. 332) | 5'-TGACCAGAAAAACATTGTTTTGCTAC-3' |
| AY177696-4 (SEQ. ID No. 333) | 5'-TTTGGGATTGGACTGCATCCCAGGAA-3' |
| AY177698-3 (SEQ. ID No. 344) | 5'-TGATTGCCCTCTTTCCATCCCAATAGG-3' |
| AY177698-4 (SEQ. ID No. 345) | 5'-GTTAACCTAAAAGAAATATTGTTCAG-3' |
| AY177699-3 (SEQ. ID No. 358) | 5'-TAGAAACAGATGGACGCTTGACGTTCA-3' |
| AY177699-4 (SEQ. ID No. 359) | 5'-AGGCTTGGTGCAAGGATACGAAATCTTG-3' |
| AY177700-3 (SEQ. ID No. 368) | 5'-TAGCCGTCAAAGGACCTTGGTCAATTC-3' |
| AY177700-4 (SEQ. ID No. 369) | 5'-TAATTTTACTAGTACTTTTACTTTGAC-3' |
| AY177702-3 (SEQ. ID No. 381) | 5'-TAAGACTATGCCGTACAAGCTGGACGA-3' |
| AY177702-4 (SEQ. ID No. 382) | 5'-CCGTGGTTGTCACAGAAGACCAATCTATAC-3' |
| AY224482-3 (SEQ. ID No. 394) | 5'-TAAGACTATGCCGTACAAGCTGGACGA-3' |
| AY224482-4 (SEQ. ID No. 395) | 5'-CCGTGGTTGTCACAGAAGACCAATCTATAC-3' |
| AY250075-3 (SEQ. ID No. 407) | 5'-TAGAAGATGTTCAGATGAAATGGTCCCT-3' |
| AY250075-4 (SEQ. ID No. 408) | 5'-AAAAAAATCACCGGCGTCAAATATTTAGGGA-3' |

| | |
|---|---|
| L37527-3 (SEQ. ID No. 421) | 5'-TAGGCTGCTGAGCACTGCCAATTTG-3' |
| L37527-4 (SEQ. ID No. 422) | 5'-TGCTGGTGCTCGAGGTGCTGAGCGCG-3' |
| | |
| L37528-3 (SEQ. ID No. 434) | 5'-TAGTTTTGGTGTAGACACCGTACGTAC-3' |
| L37528-4 (SEQ. ID No. 435) | 5'-TGAAAGCTACATTTTAGCCTTGTATTTG-3' |
| | |
| U78891-3 (SEQ. ID No. 445) | 5'-TGAACAGTGCGTGCATGAACACCTACATG-3' |
| U78891-4 (SEQ. ID No. 446) | 5'-GATGTTTTTTTTGTCTTTTGATGCAAGGCC-3' |
| AF095646-3 (SEQ ID No. 510) | 5'-TGAAGTCCAAGCTTGCTAATAAAAACGCTG-3' |
| AF095646-4 (SEQ ID No. 511) | 5'-AAGGGTAGGGCTGCACGAAATGC-3' |

| primers to mutagenize 5'-regulatory sequence | |
|---|---|
| name | sequence |
| AB003322-5 (SEQ. ID No. 137) | 5'-CGCGCGGCGGCGATCGCGCGGGAGAGGCGG-3' |
| AB003322-6 (SEQ. ID No. 138) | 5'-CTTCTGTTGGACAGTATCAATGAAATC-3' |
| AB003322-7 (SEQ. ID No. 139) | 5'-ATTTCATCCATGCTACAATTTATTTT-3' |
| AB003322-8 (SEQ. ID No. 140) | 5'-AGAAGGCCGAGGAGGTCTCCGTGCTC-3' |
| | |
| AB003324-5 (SEQ. ID No. 149) | 5'-TCGAGCGGGAGATCGAGATCGGGCGAGGCA-3' |
| AB003324-6 (SEQ. ID No. 150) | 5'-AATTCATATTTCAGCATCCTTAAGAC-3' |
| AB003324-7 (SEQ. ID No. 151) | 5'-ACTGTGCAGATGAGGTCATGCGCTCAT-3' |
| AB003324-8 (SEQ. ID No. 152) | 5'-AGGCCTACGAGCTGTCCATCCTCTGCGA-3' |
| AB003324-9 (SEQ. ID No. 153) | 5'-ACGCGTCCGGCCATCGCTGCCTAGCTAG-3' |
| | |
| AB077760-5 (SEQ. ID No. 171) | 5'- GCTGCAGGGGGCGGCCATCGGGAGGGGCAAGATCGA-3' |
| AB077760-6 (SEQ. ID No. 172) | 5'- CGCACGGCGATCATCAAGAAGGCCAG-3' |
| AB077760-7 (SEQ. ID No. 173) | 5'- TCGCCATCATCATCTTCTCCTCCAC-3' |
| AB077760-8 (SEQ. ID No. 174) | 5'- ATGAAGAAGGCCAGGGTGCTCACCGTGCTCT-3' |
| | |
| AB095645-5 (SEQ. ID No. 183) | 5'- AGGAGGCGGGATCGGGCGCGGGAAG-3' |
| AB095645-6 (SEQ. ID No. 184) | 5'- GAAACGTGGGCCATCGCCATTGAGCGAAA-3' |
| AB095645-7 (SEQ. ID No. 185) | 5'- TTCCTCTTCCTCCCATCGCGAACTCCT-3' |
| AB095645-8 (SEQ. ID No. 186) | 5'- TGCCGTTTCTGGAGCTGCCCTACTGA-3' |
| | |
| AF139664-5 (SEQ. ID No. 197) | 5'- AGAACAGGAGGAAGAAGGGGCGGGGCAA-3' |
| AF139664-6 (SEQ. ID No. 198) | 5'- TACGCCACCGACTCAAGGTACGTACGTAC-3' |
| AF139664-7 (SEQ. ID No. 199) | 5'- TCATTTTTCACAGTATCGACAAAATCCT-3' |
| AF139664-8 (SEQ. ID No. 200) | 5'-TGGGCAGGAAAAGGCATGGCCCACCCCCA-3' |

| | |
|---|---|
| AF139664-9 (SEQ. ID No. 201) | 5'-TGCTTTGATTAATACAGCTCGCAGCGAC-3' |
| | |
| AF139665-5 (SEQ. ID No. 211) | 5'-CCGCCGACGACGATCGGGAGAGGGCCGGT-3' |
| AF139665-6 (SEQ. ID No. 212) | 5'-TCTTCTGTAGTATCGAAGGGATCCTTG-3' |
| AF139665-7 (SEQ. ID No. 213) | 5'-TCGCCGCGCCGCGCGATGGGCGAGCT-3' |
| | |
| AF141964-5 (SEQ. ID No. 222) | 5'-GGGTTTTTCGGGGCGGGGAAGGCGCGGAGGGGGA-3' |
| AF141964-6 (SEQ. ID No. 223) | 5'-TGAAGTTGTCCATGCTTACTAATACTCAAA-3' |
| AF141964-7 (SEQ. ID No. 224) | 5'-ATTGGTTTTCCCATGCGTGTGATGGATATTC-3' |
| AF141964-8 (SEQ. ID No. 225) | 5'-GACCAAAACCAGCCCATGCTGCATGGTACACTATTAGGCT-3' |
| AF141964-9 (SEQ. ID No. 226) | 5'-CCTAATAAGAAACCGATGGGTATAAAATGGAGA-3' |
| | |
| AF141965-5 (SEQ. ID No. 236) | 5'-GAGAGATCGGGATCGATCGTGCGGCGGA-3' |
| AF141965-6 (SEQ. ID No. 237) | 5'-TCCAAGCGCCGGAAAGGCCTCCTCAAGAA-3' |
| AF141965-7 (SEQ. ID No. 238) | 5'-GAAAATGGAGGATGCAGAATATATATCCT-3' |
| AF141965-8 (SEQ. ID No. 239) | 5'-AACAACTGTTCCAAGGAGCATGTCCAC-3' |
| AF141965-9 (SEQ. ID No. 240) | 5'-CTTCTCGCGCGCCCGCGATTTCCGTT-3' |
| AF141965-10 (SEQ. ID No. 241) | 5'-TCTCCCCCCGCGGCGGCCTCTACGA-3' |
| | |
| AF174093-5 (SEQ. ID No. 250) | 5'-GGCGAGGTCGCGTTCGGGCAAGGGAA-3' |
| AF174093-6 (SEQ. ID No. 251) | 5'-GAAGATCGAGATCAAGAGGATCGAGGAC-3' |
| AF174093-7 (SEQ. ID No. 252) | 5'-CGTGCTGTGCGAAGCGCAGGTCGGC-3' |
| AF174093-8 (SEQ ID No. 253) | 5'-AAGAAGGCGAACCAGCTCGCCGTGC-3' |
| | |
| AF204063-5 (SEQ. ID No. 262) | 5'-AGGAGGAGGAAGAAGATCGGGAGGGGGAA-3' |
| AF204063-6 (SEQ. ID No. 263) | 5'-TCTCCAGCTCATCTTGGTACGTATAGCA-3' |
| AF204063-7 (SEQ. ID No. 264) | 5'-TTCACTTCCAGCATCTACAAAACCTTG-3' |
| AF204063-8 (SEQ. ID No. 265) | 5'-ATCTTCTCCGGCCGCCGCCGCCTCTT-3' |
| AF204063-9 (SEQ. ID No. 266) | 5'-GTCCAGCTAGCCAAGGATGGATATATTA-3' |
| | |
| AF345911-5 (SEQ. ID No. 275) | 5'-AGCGGCGAGGATCGGGCGGGGGAAGGT-3' |
| AF345911-6 (SEQ. ID No. 276) | 5'-GTTTTCCCTGCAGGATCGACAAAATCCT-3' |
| AF345911-7 (SEQ. ID No. 277) | 5'-CGGCCGCTTCCATCGATTTCAGCTGCT-3' |
| | |
| AF424549-5 (SEQ. ID No. 287) | 5'-AGGGGGCGGCGATGGGGAGGGGCAAGAT-3' |
| AF424549-6 (SEQ. ID No. 287) | 5'-CCGCACGGGGATCATCAAGAAGGCCAG-3' |
| AF424549-7 (SEQ. ID No. 289) | 5'-AGGTCGCCATCATCAAGTTCTCCTCCA-3' |
| AF424549-8 (SEQ. ID No. 290) | 5'-TTGCATCTATCCATCGTTAAAACAAGTC-3' |

| | |
|---|---|
| AJ293816-5 (SEQ. ID No. 299) | 5'-TGTGTGATCTGATAAGGCTGGCGGCGGCGGT-3' |
| AJ293816-6 (SEQ. ID No. 300) | 5'-TACATTGATGAAGCATCGAACAGATTATTG-3' |
| | |
| AY115556-5 (SEQ. ID No. 309) | 5'-CTTATCTTGATCGATCGCGCGAGGCAAG-3' |
| AY115556-6 (SEQ. ID No. 310) | 5'-TGAACAGAACCATCGAGGAGCTG-3' |
| AY115556-7 (SEQ. ID No. 311) | 5'-AGCTCTGATATAGCATGGAGGTTAATTG-3' |
| | |
| AY177695-5 (SEQ. ID No. 320) | 5'-TCGATCGATTGAAGAAGGGGAGAGGGA-3' |
| AY177695-6 (SEQ. ID No. 321) | 5'-GACAACACGAAGAACCGGCAGGTGAC-3' |
| AY177695-7 (SEQ. ID No. 322) | 5'-CGCGGCGGGCTGATCAAGAAGGCCCGGGAG-3' |
| AY177695-8 (SEQ. ID No. 323) | 5'-CTTTTTGTTAGCATCAAATCAATAATA-3' |
| AY177695-9 (SEQ. ID No. 324) | 5'-TGAAGAGCAAACCATCGAGCTAACAAACACA-3' |
| AY177695-10 (SEQ. ID No. 325) | 5'-TCAGGGATGACAACACGATGGCACCATCAGTCAT-3' |
| | |
| AY177696-5 (SEQ. ID No. 334) | 5'-TAGCGGCGAAGAAGATCGGGAGGGGGAAGA-3' |
| AY177696-6 (SEQ. ID No. 335) | 5'-GAGGTCGGCCTCAAGATCTTCTCCAG-3' |
| AY177696-7 (SEQ. ID No. 336) | 5'-CAAATATGCAGCATCAAGTCAGTTAT-3' |
| AY177696-8 (SEQ. ID No. 337) | 5'-CAGCATGGGCCATCGCCAGCTCTTCTCT-3' |
| | |
| AY177698-5 (SEQ. ID No. 346) | 5'-ACCAACCTGATCAAAGGGGCGTGGGA-3' |
| AY177698-6 (SEQ. ID No. 347) | 5'-TCCAAGAGGAGGATCGGGCTGCTCAAGAAA-3' |
| AY177698-7 (SEQ. ID No. 348) | 5'-AGGCACTGGCAAGAAGTACGAGTACT-3' |
| | |
| AY177699-5 (SEQ. ID No. 360) | 5'-ATCGGCCAGAATCGGGAGGGGGCGCA-3' |
| | |
| AY177700-5 (SEQ. ID No. 370) | 5'-AAGAGTGAAACAACAAGGTCAGAGGA-3' |
| AY177700-6 (SEQ. ID No. 371) | 5'-GAAAGGTGCAAATCCGACGAATAGAG-3' |
| AY177700-7 (SEQ. ID No. 372) | 5'-ATTAGCTACTAAAGGGTGTGTTTCCA-3' |
| AY177700-8 (SEQ. ID No. 373) | 5'-AAAATGCAAGAAATTTGCATAACTTG-3' |
| | |
| AY177702-5 (SEQ. ID No. 382) | 5'-GAGAGCGAGGAGATCGGGAGGGGGAAGA-3' |
| AY177702-6 (SEQ. ID No. 384) | 5'-TTACTTGCATGCTAGCTTGAAAACTGT-3' |
| AY177702-7 (SEQ. ID No. 385) | 5'-ATCCTAAATTTTCATCGATGGCATCTAG-3' |
| AY177702-8 (SEQ. ID No. 386) | 5'-GATCAGGACCATGCCAGTCTGATGGCCAA-3' |
| AY177702-9 (SEQ. ID No. 387) | 5'-GCACAAGGAAAGCCTTGGAACATCTT-3' |

| | |
|---|---|
| AY224482-5 (SEQ. ID No. 396) | 5'-GAGAGCGAGGAGATCGGGAGGGGGAAGA-3' |
| AY224482-6 (SEQ. ID No. 397) | 5'-CTTGCATGCTAGCTTGAAAACTGTGA-3' |
| AY224482-7 (SEQ. ID No. 398) | 5'-CTAAATTTTCATGCATGGCATCTAG-3' |
| AY224482-8 (SEQ. ID No. 399) | 5'-TGATCAGGACCATCGCAGTCTGATGG-3' |
| AY224482-9 (SEQ. ID No. 400) | 5'-CAAGGAAAGCCAAGGAACATCTTTAC-3' |
| | |
| AY250075-5 (SEQ. ID No. 409) | 5'-AGAGAGAGAGATGAAGGGGAGGGGGAA-3' |
| AY250075-6 (SEQ. ID No. 410) | 5'-TATTGATAGTATCGAGCGAATCCTTG-3' |
| AY250075-7 (SEQ. ID No. 411) | 5'-CAGTTGGTTGCCAAGGCGCGTTGCCGA-3' |
| AY250075-8 (SEQ. ID No. 412) | 5'-GAGCCTCGGCCATGCCCAGCTCCTTCCT-3' |
| AY250075-9 (SEQ. ID No. 413) | 5'-CTATTATTTTAAGAAAGCATGGATTATATAG-3' |
| AY250075-10 (SEQ. ID No. 414) | 5'-TGAGACAGACCCATGCCTGGGCCTAC-3' |
| | |
| L37527-5 (SEQ. ID No. 423) | 5'-GAGGAGTTGGATATCGGGCGCGGCAAGAT-3' |
| L37527-6 (SEQ. ID No. 424) | 5'-ACCTCCATTCCTTGCATGGCGGCCT-3' |
| L37527-7 (SEQ. ID No. 425) | 5'-TACTCCACTCCAACGATGGCGTCCAGT-3' |
| | |
| L37528-5 (SEQ. ID No. 436) | 5'-AGCATACCCATCCATCTTGAACATGATGGT-3' |
| L37528-6 (SEQ. ID No. 437) | 5'-CATCCATCTTGAACATCTTGGTAAATTCTGGCT-3' |
| | |
| U78891-5 (SEQ. ID No. 447) | 5'-AGATCGATCGGGATCGGGAGGGGTCGGGT-3' |
| U78891-6 (SEQ. ID No. 448) | 5'-GAACTTTGTAGCATCACTAAAACGCT-3' |
| U78891-7 (SEQ. ID No. 449) | 5'-GTCCATGAAACAAACCGATGGTAATTGC-3' |
| AF095646-5 (SEQ ID No. 512) | 5'-CAAAAGTTGAGGGATTGGATCGATCAGA-3' |
| AF095646-6 (SEQ ID No. 513) | 5'-GATTGGATCGATCAGAGATCGGGAGGGGAAGGGT-3' |
| AF095646-7 (SEQ ID No. 514) | 5'-GTTTTGTTTCCTTCGATGGGATGCGTATTC-3' |
| AF0956461-8 (SEQ ID No. 515) | 5'-GAAGGCGTACGAGGTCTCCGTGCTCTG-3' |

| primers to mutagenize 3'-regulatory sequence | |
|---|---|
| name | sequence |
| | |
| AB003328-5 (SEQ. ID No. 162) | 5'- CGTATTGTCGTCCATGCATGCGAAATGCTA-3' |
| | |
| AB095645-9 (SEQ. ID No. 187) | 5'- GTAAAATTGCAGATCGATGGATGTCTCCA-3' |
| AB095645-10 (SEQ. ID No. 188) | 5'- GAACCTCTCCATGCCGTGCACCCCG-3' |
| | |
| AF139664-10 (SEQ ID No. 202) | 5'-ACCTGACCCGGTCCCGTCGCCTGCTGCT-3' |

| | |
|---|---|
| AF141964-10 (SEQ. ID No. 227) | 5'-AGAGAAAAGAGTTGCCTTGGCCTCTGGCTCTGC-3' |
| AF345911-8 (SEQ. ID No. 278) | 5'-AGAACTATTCCAAGGTAATTGTACCATC-3' |
| AY177698-8 (SEQ. ID No. 349) | 5'-AGGAGGCCAACCTGCATGGCTACGTTCTT-3' |
| AY177698-9 (SEQ. ID No. 340) | 5'-GCTCGTTTGATCCAAGGACAAGATCA-3' |
| AY177698-10 (SEQ. ID No. 351) | 5'-TTCCTAAGGACACGATGGAGTCTGGA-3' |
| AY177699-6 (SEQ. ID No. 361) | 5'-AGTCGCCCCCGGCCTTTTAAGAGCCGCA-3' |
| AY177700-9 (SEQ. ID No. 374) | 5'-TAGGATTCATAACGATGGACATGTTC-3' |
| L37527-8 (SEQ. ID No. 426) | 5'-ACGGCAGCGGCCCGTCCGGCAGCTCCGGGA-3' |
| L37527-9 (SEQ. ID No. 427) | 5'-GAACCTCTCCATCGCGCCGCCCCGGGGGCT-3' |
| L37528-7 (SEQ. ID No. 438) | 5'-ATGTGAGGACCATCGATTGATGCATTG-3' |
| U78891-8 (SEQ. ID No. 450) | 5'-ACCTACATGCCCGCATGGCTACCATGAT-3' |
| U78891-9 (SEQ. ID No. 451) | 5'-TCGTCGTTTTCTCGATGGCCTTGCAT-3' |
| AF095646-9 (SEQ ID No. 516) | 5'-CCCTTCCTTACCCATGCTGGTAACAAATATG-3' |

| primers to clone 3'-regulatory sequence in pNOV6901 | |
|---|---|
| name | sequence |
| AB003322-9 (SEQ. ID No. 141) | 5'-TAATAAGAGCTCTGAAAGGAAAAAAAAAGCA-3' |
| AB003322-10 (SEQ. ID No. 142) | 5'-ATATATGCGGCCGCGGTCCGAATAAATCTGGCAACTGA-3' |
| AB003324-10 (SEQ. ID No. 154) | 5'-ATATATGCGGCCGCGGTCCGTGGAGATCGACCACAATTAAATTC-3' |
| AB003324-11 (SEQ. ID No. 155) | 5'-TAGGTAGAGCTCCTAGCTAGCTAGCTACCGTTTCA-3' |
| AB003328-6 (SEQ. ID No. 163) | 5'-TAATAAGAGCTCGTAACAGGCCAGGAATAAGCT-3' |
| AB003328-7 (SEQ. ID No. 164) | 5'-ATATATGCGGCCGCGGTCCGATTGCCGGGCTATAGCCTT-3' |
| AB077760-11 (SEQ. ID No. 175) | 5'-ATGCATGAGCTCTATATCATCGCCGC-3' |
| AB077760-12 (SEQ. ID No. 176) | 5'-ATATATGCGGCCGCGGTCCGTGGTACTGAAATC-3' |

| | |
|---|---|
| AB095645-13 (SEQ. ID No. 189) | 5'- TAATAAGAGCTCGCTGCTAGGTTGCCCCGCCACT-3' |
| AB095645-14 (SEQ. ID No. 190) | 5'- TAATAAGCGGCCGCGGTCCGCACGGCTACCTCTCGCCGGA-3' |
| | |
| AF139664-11 (SEQ. ID No. 203) | 5'- TAATAAGAGCTCGGAGGCTTCAGATCCATACCA-3' |
| AF139664-12 (SEQ. ID No. 204) | 5'- ATATATGCGGCCGCGGTCCGGATAAACATTGTGAAGCAAC-3' |
| | |
| AF139665-8 (SEQ. ID No. 214) | 5'-TGATGAGCGGCCGCAGGCATCTGTTGATCTCA-3' |
| AF139665-9 (SEQ ID No. 215) | 5'-TATATAACTAGTGCGGTCCGATGAACTCCACCTCGGGAAC-3' |
| | |
| AF141964-11 (SEQ. ID No. 228) | 5'-TGATGAGCGGCCGCAGGAAGCACAGGTGT-3' |
| AF141964-12 (SEQ. ID No. 229) | 5'-ATATATCCCGGGCGGTCCGATGAGATACAATCTAGTAC-3' |
| | |
| AF141965-11 (SEQ. ID No. 242) | 5'-TGATGAGCGGCCGCAGAAGGCCAGCCACA-3' |
| AF141965-12 (SEQ. ID No. 243) | 5'-TATATACCCGGGCGGTCCGCCTTATCGAATATTCA-3' |
| | |
| AF174093-10 (SEQ. ID No. 254) | 5'-TGATGAGAGCTCCTTCCTGGAAGCAGTAG-3' |
| AF174093-11 (SEQ. ID No. 255) | 5'-ATATATGCGGCCGCGGTCCGCCCCTTCTCCTCCTCCGGGA-3' |
| | |
| AF204063-10 (SEQ. ID No. 267) | 5'-TATATACCCGGGCGGTCCGCTGCATATACTTGCAACA-3' |
| AF204063-11 (SEQ. ID No. 268) | 5'-TGATGAGCGGCCGCTGTGTGTGTTCAGTTCAG-3' |
| | |
| AF345911-9 (SEQ. ID No. 279) | 5'-TAATAAGCGGCCGCGATGATCATCGTCGTCGT-3' |
| AF345911-10 (SEQ. ID No. 280) | 5'-TATATACCCGGGCGGTCCGTTGACTTAAATGGCAAG-3' |
| | |
| AF424549-9 (SEQ. ID No. 291) | 5'-TGATGAGCGGCCGCGATATCATCGCCGCCG-3' |
| AF424549-10 (SEQ. ID No. 292) | 5'-TATATACCCGGGCGGTCCGTTTTATTATCTTGGCGA-3' |
| | |
| AJ293816-7 (SEQ. ID No. 301) | 5'-TGATGAGCGGCCGCTGGCTGGAAACTAAAACT-3' |
| AJ293816-8 (SEQ. ID No. 302) | 5'-TATATACCCGGGCGGTCCGTTTGAAACATTTCGGCCCT-3' |
| | |
| AY115556-8 (SEQ. ID No. 312) | 5'-TAATAAGCGGCCGCACTAATAATGGCCTGG-3' |
| AY115556-9 (SEQ. ID No. 313) | 5'-TATATACCCGGGCGGTCCGAACTTTGCACGAATG-3' |
| | |
| AY177695-11 (SEQ. ID No. 325) | 5'-TAATAAGAGCTCCACATGATCAAGTGTTAAAAAC-3' |
| AY177695-12 (SEQ. ID No. 326) | 5'-TATATAGCGGCCGCGGTCCGGCTCGGTCAAACCAGCGT-3' |
| | |
| AY177696-9 (SEQ. ID No. 338) | 5'-TGATGAGAGCTCCCAGAAAAACATTGTTTTG-3' |
| AY177696-10 (SEQ. ID No. 339) | 5'-TATATAGCGGCCGCGGTCCGTTTGGGATTGGAC-3' |

| | |
|---|---|
| AY177698-11 (SEQ. ID No. 325) | 5'-TGATGAGCGGCCGCTTGCCCTCTTTCCATC-3' |
| AY177698-12 (SEQ. ID No. 353) | 5'-TATATACCCGGGCGGTCCGTTAACCTAAAAGAAAT-3' |
| | |
| AY177699-7 (SEQ. ID No. 362) | 5'-TAGTAGGCGGCCGCAAACAGATGGACGCTTGA-3' |
| AY177699-8 (SEQ. ID No. 363) | 5'-TATATACCCGGGCGGTCCGAGGCTTGGTGCAAG-3' |
| | |
| AY177700-10 (SEQ. ID No. 375) | 5'-TAGTAGGCGGCCGCGTCAAAGGACCT-3' |
| AY177700-11 (SEQ. ID No. 376) | 5'-TATATACCCGGGCGGTCCGTAATTTTACTAGTACT-3' |
| | |
| AY177702-10 (SEQ. ID No. 388) | 5'-TAATAAGAGCTCGACTATGCCGTACAAGC-3' |
| AY177702-11 (SEQ. ID No. 389) | 5'-ATATATGCGGCCGCGGTCCGTGGTTGTCACAG-3' |
| | |
| AY224482-10 (SEQ. ID No. 401) | 5'-TAATAAGAGCTCGACTATGCCGTACAAGC-3' |
| AY224482-11 (SEQ. ID No. 402) | 5'-TATATAGCGGCCGCGGTCCGTGGTTGTCACAGA-3' |
| | |
| AY250075-11 (SEQ. ID No. 415) | 5'-TAGTAGAGCTCAAGATGTTCAGATGAAATG-3' |
| AY250075-12 (SEQ. ID No. 416) | 5'-TATATAGCGGCCGCGGTCCGAAAAAAATCACCGGCGT-3' |
| | |
| L37527-10 (SEQ. ID No. 428) | 5'-TAGTAGAGCTCGCTGCTGAGCACTGCCA-3' |
| L37527-11 (SEQ. ID No. 429) | 5'-TATATAGCGGCCGCGGTCCGTGCTGGTGCTCGAGGT-3' |
| | |
| L37528-8 (SEQ. ID No. 439) | 5'-TAGTAGAGCTCTTTTGGTGTAGACACC-3' |
| L37528-9 (SEQ. ID No. 440) | 5'-ATATAGCGGCCGCGGTCCGTGAAAGCTACATTTTAGC-3' |
| | |
| U78891-10 (SEQ. ID No. 452) | 5'-TGATGAGCTCACAGTGCGTGCATGAACA-3' |
| U78891-11 (SEQ. ID No. 453) | 5'-TATATAGCGGCCGCGGTCCGATGTTTTTTTTTGTCTTTTGATGC-3' |
| AF095646-10 (SEQ ID No. 517) | 5'-ATATATCTCGAGCGGACCGTCTTGCATGCATGCGTACTGGTGA-3' |
| AF095646-11 (SEQ ID No. 518) | 5'-ATATATCCATGGTGGGTTTATTCTGCAAACAAAAATAG-3' |

| primers to clone 5'-regulatory sequence in pNOV6901 | |
|---|---|
| name | sequence |
| AB003322-10 (SEQ. ID No. 142) | 5'-TATATACCATGGTGGTGATACTGTCCAACAGAAGG-3' |
| AB003322-11 (SEQ. ID No. 143) | 5'-ATATATGGATCCGGACCGTTGCCCAGCGAGGAGCATG-3' |
| | |
| AB003324-12 (SEQ. ID No. 156) | 5'-ATATATGGATCCGGACCGTCTAAATAGGGCCCAACATAC-3' |
| AB003324-13 (SEQ. ID No. 157) | 5'-TATATACCATGGTGGCTTAAGGATGCTGAAATATGA-3' |

| | |
|---|---|
| AB003328-8 (SEQ. ID No. 165) | 5'- TATATAGGATCCGGACCGAACAAAACCAATAATCTCCAATG-3' |
| AB003328-9 (SEQ. ID No. 166) | 5'- TATATACCATGGTGGATCGCCGATGAACCAACCAAC-3' |
| | |
| AB077760-9 (SEQ. ID No. 177) | 5'- ATATATGTCGACGGACCGATTCGTTGGGGGTGACATGAC-3' |
| AB077760-10 (SEQ. ID No. 178) | 5'- TACAGTACCATGGTGGCCCTTGATGCTGCAGCAGGAT-3' |
| | |
| AB095645-11 (SEQ. ID No. 191) | 5'- GAGAGACCTGCAGGCGGACCGCTCGTCGCCGTCGTTGGCTCGGCGT-3' |
| AB095645-12 (SEQ. ID No. 192) | 5'- ATATATCCATGGTGGTTGATAGCCTTATACATGTCCC-3' |
| | |
| AF139664-13 (SEQ. ID No. 205) | 5'- ATATATGGATCCGGACCGTGCATCCTTACAAAGAGACA-3' |
| AF139664-14 (SEQ. ID No. 206) | 5'- TATATACCATGGTGGTTGTCCATACTGTGAAAAATG-3' |
| | |
| AF139665-10 (SEQ. ID No. 216) | 5'-ATATATGTCGACGGACCGACCTGGGGTTTGGAAATG-3' |
| AF139665-11 (SEQ. ID No. 217) | 5'-TATATACCATGGTGGCCTTCCATACTACAGAAG-3' |
| | |
| AF141964-13 (SEQ. ID No. 230) | 5'-ATATATCCTGCAGGCGGACCGAAAACACTGATTAAAGGGT-3' |
| AF141964-14 (SEQ. ID No. 231) | 5'-ATATATCCATGGTGGCCTTCAATGCTGAAAAAGAAAAC-3' |
| | |
| AF141965-13 (SEQ. ID No. 244) | 5'-ATATATGGATCCGGACCGTGTTTCTCGATTAGGCTAC-3' |
| AF141965-14 (SEQ. ID No. 245) | 5'-ATATATCCATGGTGGTCTGTAGGCTGCAGAACAGACAC-3' |
| | |
| AF174093-12 (SEQ. ID No. 256) | 5'-TATATCCTGCAGGCGGACCGAAAATTCACAAGTATAATTC-3' |
| AF174093-13 (SEQ. ID No. 257) | 5'-TATATACCATGGTGGTCAAGCTTAACAAAGCAT-3' |
| | |
| AF204063-12 (SEQ. ID No. 269) | 5'-TATATAGGATCCGGACCGACAAATTTGTTGTACCAC-3' |
| AF204063-13 (SEQ. ID No. 270) | 5'-ATATATCCATGGTGGTGTACATGCTGGAAGTGA-3' |
| | |
| AF345911-11 (SEQ. ID No. 281) | 5'-TATATAGTCGACGGACCGAAAATCTCAAGGTTTC-3' |
| AF345911-12 (SEQ. ID No. 282) | 5'-TATATACCATGGTGGTTGTCGATCCTGCAGGGAA-3' |
| | |
| AF424549-11 (SEQ. ID No. 293) | 5'-TATATAGTCGACGGACCGTACAAAGTGCTGGAAGT-3' |
| AF424549-12 (SEQ. ID No. 294) | 5'-TATATACCATGGTGGTGATGCTGCAGCAGGATGCA-3' |
| | |
| AJ293816-9 (SEQ. ID No. 303) | 5'-TATATAGTCGACGGACCGCAAACATTTTAAACTTTAAC-3' |
| AJ293816-10 (SEQ. ID No. 304) | 5'-TATATACCATGGTGGTGTTCGATGCTTCATCAATGT-3' |
| | |
| AY115556-10 (SEQ. ID No. 314) | 5'-TATATACCTGCAGGCGGACCGATATAAAAACCTACTTTATG-3' |

| | |
|---|---|
| AY115556-11 (SEQ. ID No. 315) | 5'-ATATATCCATGGTGGCGATGGTTCTGTTCAAAGAAATC-3' |
| AY177695-13 (SEQ. ID No. 328) | 5'-TATATAGGATCCGGACCGTCAGTCCATCATTTCGTC-3' |
| AY177695-14 (SEQ. ID No. 329) | 5'-TATATACCATGGTGGATTTGATGCTAACAAAAAGG-3' |
| AY177696-11 (SEQ. ID No. 340) | 5'-TATATAGGATCCGGACCGCAAGCAAAGAAACAAATTTCG-3' |
| AY177696-12 (SEQ. ID No. 341) | 5'-ATATACCATGGTGGCTTGATGCTGCATATTTG-3' |
| AY177698-13 (SEQ. ID No. 354) | 5'-TATATAGGATCCGGACCGAAGATTTGAACTACTGCCT-3' |
| AY177698-14 (SEQ. ID No. 355) | 5'-TATATACCATGGTGGTTTGCAATCCTGCCA-3' |
| AY177699-9 (SEQ. ID No. 364) | 5'-TATATAGGATCCGGACCGTCCGGTCGGCCCTCGTCCT-3' |
| AY177699-10 (SEQ. ID No. 365) | 5'-TATATACCATGGTGGCTCACGCTGCGCCA-3' |
| AY177700-12 (SEQ. ID No. 377) | 5'-TATATAGGATCCGGACCGATAAGTATTTCAGAAAG-3' |
| AY177700-13 (SEQ. ID No. 378) | 5'-TATATACCATGGTGGGCAAATTTCTTGCATTTTG-3' |
| AY177702-12 (SEQ. ID No. 390) | 5'-TATATAGTCGACGGACCGTCTTTTCGCAAACTAAAC-3' |
| AY177702-13 (SEQ. ID No. 391) | 5'-TATATACCATGGTGGTCAAGCTAGCATGCAAG-3' |
| AY224482-12 (SEQ. ID No. 403) | 5'-TATATAGTCGACGGACCGTCTTTTCGCAAACTAAACAAGG-3' |
| AY224482-13 (SEQ. ID No. 404) | 5'-TATATACCATGGTGGTTTTCAAGCTAGC-3' |
| AY250075-13 (SEQ. ID No. 417) | 5'-TATATACCTGCAGGCGGACCGAAATGGTTTCATTTTGG-3' |
| AY250075-14 (SEQ. ID No. 418) | 5'-TATATACCATGGTGGCGCTCGATACTATCA-3' |
| L37527-12 (SEQ. ID No. 430) | 5'-TATATACCTGCAGGCGGACCGCCAAGAGAGCCCCCT-3' |
| L37527-13 (SEQ. ID No. 431) | 5'-TATATACCATGGTGGTTGACAGCCTAAAACG-3' |
| L37528-10 (SEQ. ID No. 441) | 5'-TATATAGGATCCGGACCGACCACCTCAATCTCCACT-3' |
| L37528-11 (SEQ. ID No. 442) | 5'-TATATACCATGGTGGATCGGTCTGGACA-3' |
| U78891-12 (SEQ. ID No. 454) | 5'-TATATAGGATCCGGACCGTCTTCTTCTTGCCTTCATTTG-3' |
| U78891-13 (SEQ. ID No. 455) | 5'-TATATACCATGGTGGTTAGTGATGCTACAAAGTTC-3' |
| AF095646-12 (SEQ ID No. 519) | 5'-TATATAGAGCTCAGTCCAAGCTTGCTAATAAAAACGCT-3' |
| AF095646-13 (SEQ ID No. 520) | 5'-TATATACCCGGGCGGTCCGAAGGGTAGGGCTGCACGAA-3' |

CERTIFICATE OF CORRECTION (continued)
U.S. Pat. No. 8,129,588 B2

Column 51, Lines 54-67: Please replace the paragraph in its entirety with the following:

4.0 μL 11082 (NcoI/SacI/CIP) was ligated to 4.0 μL OsT6PP-3 (NcoI/SacI) in a 10 μL reaction mixture containing 1 μL 10X T4 DNA ligase buffer and 1 μL T4 DNA ligase (400 Units/μL). The reaction mixture was incubated more than 8 hours at 16°C. 5.0 μL of ligation mixture was transformed into 50 μL Top10 competent cells. The recombinants were verified by digesting 7.5 μL 11082-OsT6PP-3 miniprep DNA with 1.0 μL RsrII in 10 μL reaction mixtures containing 1 μg BSA and 1 μL 10X restriction endonuclease buffer. The digests were incubated at 37°C for 2 hours then resolved on 1% TAE agarose. Positive 11082-OsT6PP-3 recombinants were sequenced. The vector was designated OsMADS6-OsT6PP-Assembly and is shown in FIG. 11A.

Column 52, Lines 23-38: Please replace the paragraph in its entirety with the following:

4.0 μL pNOV6900 (RsrII/CIP) was ligated to 4.0 μL pNOV6906-OsT6PP-Assembly (RsrII) in a 10 μL ligation mixture containing 1 μL 10X T4 DNA ligase buffer and 1 μL T4 DNA ligase (400 U/μL). The ligation mixture was incubated more than 8 hours at 16°C. 5.0 μL of ligation mixture was transformed into 50 μL Top10 competent cells. The pNOV6900-pNOV6906-OsT6PP-Assembly recombinants were verified by digesting 7.5 μL miniprep DNA with 1.0 μL NcoI in 10 μL reaction mixtures containing 1 μg BSA and 1 μL 10X restriction endonuclease buffer. The digests were incubated at 37°C for 2 hours then resolved on 1% TAE agarose. Positive pNOV6900-pNOV6906-OsT6PP-Assembly recombinants were sequenced. The finished clone was designated OsMADS6-OsT6PP-Binary and is shown in FIG 27B. The plasmid's QC number is 12194.

UNITED STATES PATENT AND TRADEMARK OFFICE
CERTIFICATE OF CORRECTION

PATENT NO. : 8,129,588 B2
APPLICATION NO. : 11/109594
DATED : March 6, 2012
INVENTOR(S) : Nuccio et al.

Page 1 of 15

It is certified that error appears in the above-identified patent and that said Letters Patent is hereby corrected as shown below:

In the Patent:
Column 1, Reference To Material Submitted On Compact Disc, Lines 8-16:
    Please replace paragraph in its entirety with the following:

-- The Sequence Listing associated with the instant disclosure has been submitted as a 1.04 MB file on CD-R (in duplicate) instead of paper. Each CD-R is marked in indelible ink to identify the Applicants, Title, File Name (70369USNP.ST25.txt), Creation Date (August 14, 2006), Computer System (IBM-PC/MS-DOS/MS-Windows), and Docket No. (70369USNP). The Sequence Listing submitted on CD-R is hereby incorporated by reference into the instant disclosure. --

Columns 13-28, Table 2: In order to correct errors found throughout Table 2, please replace Table 2 in its entirety with the following:

TABLE 2
Primers for constructing expression cassettes comprising regulatory
sequences from the MADS gene family

| target gene | name | primers to clone 5'-regulatory sequence sequence |
|---|---|---|
| | | |

This certificate supersedes the Certificate of Correction issued July 10, 2012.

Signed and Sealed this
Fourth Day of September, 2012

David J. Kappos
*Director of the United States Patent and Trademark Office*

| | | |
|---|---|---|
| AB003322 | AB003322-1 (SEQ. ID No. 133) | 5'-CGTTGCCCAGCGAGGAGCATGCGTAAAATC-3' |
| | AB003322-2 (SEQ. ID No. 134) | 5'-GATTTCATTCATACTGTCCAACAGAAGGCA-3' |
| AB003324 | AB003324-1 (SEQ. ID No. 145) | 5'-TCTAAATAGGGCCAACATACTCA-3' |
| | AB003324-2 (SEQ. ID No. 146) | 5'-TCAAGCGTCTTAAGCATGCTGAAATATGA-3' |
| AB003328 | AB003328-1 (SEQ. ID No. 158) | 5'-AACAAAACCAATAATCTCCAATGCCC-3' |
| | AB003328-2 (SEQ. ID No. 158) | 5'-CATCTTCGATCGCCGATGAACCAACC-3' |
| AB077760 | AB077760-1 (SEQ. ID No. 167) | 5'- ATTCGTTGGGGGTGACATGACTAGTC-3' |
| | AB077760-2 (SEQ. ID No. 168) | 5'- CAAAGATCCCCTTGATGCTGCAGCAG-3' |
| AB095645 | AB095645-1 (SEQ. ID No. 179) | 5'-CTCGTCGCCGTCGTTGGCTCGGCGT-3' |
| | AB095645-2 (SEQ. ID No. 180) | 5'-CAAGATTCTTGATAGCCTTATACATG-3' |
| AF139664 | AF139664-1 (SEQ. ID No. 193) | 5'-TGCATCCTTACAAAGAGACAGATAGATC-3' |
| | AF139664-2 (SEQ. ID No. 194) | 5'-CAAGGATTTTGTCCATACTGTGAAAAATG-3' |
| AF139665 | AF139665-1 (SEQ. ID No. 207) | 5'- ACCTGGGGTTTGGAAATGGGGAGCG-3' |
| | AF139665-2 (SEQ. ID No. 208) | 5'- CAAGGATCCCTTCCATACTACAGAAGAAG-3' |
| AF141964 | AF141964-1 (SEQ. ID No. 218) | 5'-AAAACACTGATTAAAGGGTTGTTGAAAGGAAAACACC-3' |
| | AF141964-2 (SEQ. ID No. 219) | 5'-CATAGGTACCTTCAATGCTGAAAAAGAAAACAAGGCA-3' |
| AF141965 | AF141965-1 (SEQ. ID No. 232) | 5'-TGTTTCTCGATTAGGCTACAAGTTAAC-3' |
| | AF141965-2 (SEQ. ID No. 233) | 5'-GATGGTTTTCTGTAGGCTGCAGAACAG-3' |
| AF174093 | AF174093-1 (SEQ. ID No. 246) | 5'-AAAATTCACAAGTATAATTCGTCAC-3' |
| | AF174093-2 (SEQ. ID No. 247) | 5'-CAGCTCCATCAAGCTTAACAAAGCA-3' |
| AF204063 | AF204063-1 (SEQ. ID No. 258) | 5'-ACAAATTTGTTGTACCACCTACCTAGGGGT-3' |
| | AF204063-2 (SEQ. ID No. 259) | 5'-CAAGGTTTTGTACATGCTGGAAGTGAA-3' |
| AF345911 | AF345911-1 (SEQ. ID No. 271) | 5'-GAAAATCTCAAGGTTTCGAAAACGAC-3' |
| | AF345911-2 (SEQ. ID No. 272) | 5'-CAAGGATTTTGTCCATCCTGCAGGGAAAAC-3' |
| AF424549 | AF424549-1 (SEQ. ID No. 283) | 5'-TACAAAGTGCTGGAAGTGATAGTATGT-3' |
| | AF424549-2 (SEQ. ID No. 284) | 5'-GATCCCCTTGATGCTGCAGCAGGATGCA-3' |

| | | |
|---|---|---|
| AJ293816 | AJ293816-1 (SEQ. ID No. 295) | 5'-CAAACATTTTAAACTTTAACCATTAATAG-3' |
| | AJ293816-2 (SEQ. ID No. 296) | 5'-CAATAATCTGTTCCATGCTTCATCAATG-3' |
| AY115556 | AY115556-1 (SEQ. ID No. 305) | 5'-GATATAAAAACCTACTTTATGTTCATG-3' |
| | AY115556-2 (SEQ. ID No. 306) | 5'-CAGCTCCTCCATGGTTCTGTTCAAAGAAATC-3' |
| AY177695 | AY177695-1 (SEQ. ID No. 316) | 5'-TCAGTCCATCATTTCGTCTACAACTAA-3' |
| | AY177695-2 (SEQ. ID No. 317) | 5'-TATTATTGATTTCATGCTAACAAAAAG-3' |
| AY177696 | AY177696-1 (SEQ. ID No. 330) | 5'-CAAGCAAAGAAACAAATTTCGCAATTAG-3' |
| | AY177696-2 (SEQ. ID No. 331) | 5'-ATAACTGACTTCATGCTGCATATTTGCA-3' |
| AY177698 | AY177698-1 (SEQ. ID No. 342) | 5'-AAGATTTGAACTACTGCCTTGTCTTC-3' |
| | AY177698-2 (SEQ. ID No. 343) | 5'-CAAAGATATTTGCAATCCTGCCAAAAG-3' |
| AY177699 | AY177699-1 (SEQ. ID No. 356) | 5'-TCCGGTCGGCCCTCGTCCTCCCCGT-3' |
| | AY177699-2 (SEQ. ID No. 357) | 5'-CAAACTCCCTCACGCTGCGCCAAGAAAG-3' |
| AY177700 | AY177700-1 (SEQ. ID No. 366) | 5'-ATAAGTATTTCAGAAAGCTGAAGTTGA-3' |
| | AY177700-2 (SEQ. ID No. 367) | 5'-CAAGTTATGCATATTTCTTGCATTTTG-3' |
| AY177702 | AY177702-1 (SEQ. ID No. 379) | 5'-TCTTTTCGCAAACTAAACAAGGCCT-3' |
| | AY177702-2 (SEQ. ID No. 380) | 5'-CACAGTTTTCATGCTAGCATGCAAGTAAAG-3' |
| AY224482 | AY224482-1 (SEQ. ID No. 392) | 5'-TCTTTTCGCAAACTAAACAAGGCCTTAACA-3' |
| | AY224482-2 (SEQ. ID No. 393) | 5'-TATCACAGTTTTCATGCTAGCATGCAAGT-3' |
| AY250075 | AY250075-1 (SEQ. ID No. 405) | 5'-GAAATGGTTTCATTTTGGGACAAGTTATTG-3' |
| | AY250075-2 (SEQ. ID No. 406) | 5'-CAAGGATTCGCTCCATACTATCAATAAAATATG-3' |
| L37527 | L37527-1 (SEQ. ID No. 419) | 5'-GCCAAGAGAGCCCCCTTGCTGCTGGT-3' |
| | L37527-2 (SEQ. ID No. 420) | 5'-CAAGATCCTTGACAGCCTAAAACGCCA-3' |
| L37528 | L37528-1 (SEQ. ID No. 432) | 5'-ACCACCTCAATCTCCACTGTTTGATTG-3' |
| | L37528-2 (SEQ. ID No. 433) | 5'-CAGCTCAGATCGGTCTGGACACAAAC-3' |
| U78891 | U78891-1 (SEQ. ID No. 443) | 5'-TCTTCTTCTTGCCTTCATTTGAGTTAATTACA-3' |

| | | |
|---|---|---|
| | U78891-2 (SEQ. ID No. 444) | 5'-CAAGCGTTTTAGTCATGCTACAAAGTTC-3' |
| | AF095646-1 (SEQ ID No. 508) | 5'-TGTTGCATGCATGCGTACTGGTGATGGCCGCA-3' |
| | AF095646-2 (SEQ ID No. 509) | 5'-AATGTCTTGTTTATTCTGCAAACAAAAATAGG-3' |

| primers to clone 3'-regulatory sequence | |
|---|---|
| name | sequence |
| AB003322-3 (SEQ. ID No. 135) | 5'-TAACTGAAAGGAAAAAAAAAGCATCCTTGC-3' |
| AB003322-4 (SEQ. ID No. 136) | 5'-GAATAAATCTGGCAACTGAAATCCAACCAT-3' |
| AB003324-3 (SEQ. ID No. 147) | 5'-CTAGCTAGCTAGCTACCGTTTCAGCTTC-3' |
| AB003324-4 (SEQ. ID No. 148) | 5'-TGGAGATCGACCACAATTAAATTCGT-3' |
| AB003328-3 (SEQ. ID No. 160) | 5'-TAAGTAACAGGCCAGGAATAAGCTGG-3' |
| AB003328-4 (SEQ. ID No. 161) | 5'-ATTGCCGGGCTATAGCCTTTCTCCCT-3' |
| AB077760-3 (SEQ. ID No. 169) | 5'-TGATATATCATCGCCGCCGCCGCCG-3' |
| AB077760-4 (SEQ. ID No. 170) | 5'-CCGTGGTACTGAAATCGAAAAAGAAATG-3' |
| AB095645-3 (SEQ. ID No. 181) | 5'-TAAGCTGCTAGGTTGCCCCGCCACT-3' |
| AB095645-4 (SEQ. ID No. 182) | 5'-GCACGGCTACCTCTCGCCGGAGTACG-3' |
| AF139664-3 (SEQ. ID No. 195) | 5'-TAAGGAGGCTTCAGATCCATACCAG-3' |
| AF139664-4 (SEQ. ID No. 196) | 5'-GGATAAACATTGTGAAGCAACATTTC-3' |
| AF139665-3 (SEQ. ID No. 209) | 5'-TGAAGGCATCTGTTGATCTCAAACGTC-3' |
| AF139665-4 (SEQ. ID No. 210) | 5'-ATGAACTCCACCTCGGGAACTCAGCCT-3' |
| AF141964-3 (SEQ. ID No. 220) | 5'-TGAGCAGGAAGCACAGGTGTCCTGT-3' |
| AF141964-4 (SEQ. ID No. 221) | 5'-ATGAGATACAATCTAGTACAACGAAT-3' |
| AF141965-3 (SEQ. ID No. 234) | 5'-TGAAGAAGGCCAGCCACAGCAACAGCTG-3' |
| AF141965-4 (SEQ. ID No. 235) | 5'-CCTTATCGAATATTCAAATCTCGATG-3' |
| AF174093-3 (SEQ. ID No. 248) | 5'-TGACTTCCTGGAAGCAGTAGGAAC-3' |
| AF174093-4 (SEQ. ID No. 249) | 5'-CCCCTTCTCCTCCTCCGGGAAGAAG-3' |
| AF204063-3 (SEQ. ID No. 260) | 5'-TGATGTGTGTGTTCAGTTCAGGCTT-3' |

| | |
|---|---|
| AF204063-4 (SEQ. ID No. 261) | 5'-CTGCATATACTTGCAACATTGCAATTTTA-3' |
| AF345911-3 (SEQ. ID No. 273) | 5'-TAAGATGATCATCGTCGTCGTCGTCG-3' |
| AF345911-4 (SEQ. ID No. 274) | 5'-TTGACTTAAATGGCAAGATAAATTAGATATAG-3' |
| AF424549-3 (SEQ. ID No. 285) | 5'-TGAGATATCATCGCCGCCGCCGCCGCCG-3' |
| AF424549-4 (SEQ. ID No. 286) | 5'-TTTTATTATCTTGGCGAGGCCCAAGCACCTTTG-3' |
| AJ293816-3 (SEQ. ID No. 297) | 5'-TGATGGCTGGAAACTAAAACTGAGAGGA-3' |
| AJ293816-4 (SEQ ID No. 298) | 5'-TTTGAAACATTTCGGCCCTGGCTCTCCT-3' |
| AY115556-3 (SEQ. ID No. 307) | 5'-TAACACTAATAATGGCCTGGGGGATAC-3' |
| AY115556-4 (SEQ. ID No. 308) | 5'-AACTTTGCACGAATGATTAAATTGCAT-3' |
| AY177695-3 (SEQ. ID No. 318) | 5'-TAACACATGATCAAGTGTTAAAAACAG-3' |
| AY177695-4 (SEQ. ID No. 319) | 5'-GGCTCGGTCAAACCAGCGTGGTGAGCT-3' |
| AY177696-3 (SEQ. ID No. 332) | 5'-TGACCAGAAAAACATTGTTTTGCTAC-3' |
| AY177696-4 (SEQ. ID No. 333) | 5'-TTTGGGATTGGACTGCATCCCAGGAA-3' |
| AY177698-3 (SEQ. ID No. 344) | 5'-TGATTGCCCTCTTTCCATCCCAATAGG-3' |
| AY177698-4 (SEQ. ID No. 345) | 5'-GTTAACCTAAAAGAAATATTGTTCAG-3' |
| AY177699-3 (SEQ. ID No. 358) | 5'-TAGAAACAGATGGACGCTTGACGTTCA-3' |
| AY177699-4 (SEQ. ID No. 359) | 5'-AGGCTTGGTGCAAGGATACGAAATCTTG-3' |
| AY177700-3 (SEQ. ID No. 368) | 5'-TAGCCGTCAAAGGACCTTGGTCAATTC-3' |
| AY177700-4 (SEQ. ID No. 369) | 5'-TAATTTTACTAGTACTTTTACTTTGAC-3' |
| AY177702-3 (SEQ. ID No. 381) | 5'-TAAGACTATGCCGTACAAGCTGGACGA-3' |
| AY177702-4 (SEQ. ID No. 382) | 5'-CCGTGGTTGTCACAGAAGACCAATCTATAC-3' |
| AY224482-3 (SEQ. ID No. 394) | 5'-TAAGACTATGCCGTACAAGCTGGACGA-3' |
| AY224482-4 (SEQ. ID No. 395) | 5'-CCGTGGTTGTCACAGAAGACCAATCTATAC-3' |
| AY250075-3 (SEQ. ID No. 407) | 5'-TAGAAGATGTTCAGATGAAATGGTCCCT-3' |
| AY250075-4 (SEQ. ID No. 408) | 5'-AAAAAAATCACCGGCGTCAAATATTAGGGA-3' |

| | |
|---|---|
| L37527-3 (SEQ. ID No. 421) | 5'-TAGGCTGCTGAGCACTGCCAATTTG-3' |
| L37527-4 (SEQ. ID No. 422) | 5'-TGCTGGTGCTCGAGGTGCTGAGCGCG-3' |
| | |
| L37528-3 (SEQ. ID No. 434) | 5'-TAGTTTTGGTGTAGACACCGTACGTAC-3' |
| L37528-4 (SEQ. ID No. 435) | 5'-TGAAAGCTACATTTTAGCCTTGTATTTG-3' |
| | |
| U78891-3 (SEQ. ID No. 445) | 5'-TGAACAGTGCGTGCATGAACACCTACATG-3' |
| U78891-4 (SEQ. ID No. 446) | 5'-GATGTTTTTTTTTGTCTTTTGATGCAAGGCC-3' |
| AF095646-3 (SEQ.ID No. 510) | 5'-TGAAGTCCAAGCTTGCTAATAAAAACCGCTG-3' |
| AF095646-4 (SEQ ID No. 511) | 5'-AAGGGTAGGGCTGCACGAAATGC-3' |

| primers to mutagenize 5'-regulatory sequence | |
|---|---|
| name | sequence |
| AB003322-5 (SEQ. ID No. 137) | 5'-CGCGCGGCUGCGATCGCGCGGGAGAGGCGG-3' |
| AB003322-6 (SEQ. ID No. 138) | 5'-CTTCTGTTGGACAGTATCAATGAAATC-3' |
| AB003322-7 (SEQ. ID No. 139) | 5'-ATTTCATCCATGCTACAATTTATTTT-3' |
| AB003322-8 (SEQ. ID No. 140) | 5'-AGAAGGCCGAGGAGGTCTCCGTGCTC-3' |
| | |
| AB003324-5 (SEQ. ID No. 149) | 5'-TCGAGCGGGAGATCGAGATCGGGCGAGGCA-3' |
| AB003324-6 (SEQ. ID No. 150) | 5'-AATTCATATTTCAGCATCCTTAAGAC-3' |
| AB003324-7 (SEQ. ID No. 151) | 5'-ACTGTGCAGATGAGGTCATGCGCTCAT-3' |
| AB003324-8 (SEQ. ID No. 152) | 5'-AGGCCTACGAGCTGTCCATCCTCTGCGA-3' |
| AB003324-9 (SEQ. ID No. 153) | 5'-ACGCGTCCGGCCATCGCTGCCTAGCTAG-3' |
| | |
| AB077760-5 (SEQ. ID No. 171) | 5'-GCTGCAGGGGGCGGCCATCGGGAGGGGCAAGATCGA-3' |
| AB077760-6 (SEQ. ID No. 172) | 5'-CGCACGGGCATCATCAAGAAGGCCAG-3' |
| AB077760-7 (SEQ. ID No. 173) | 5'-TCGCCATCATCATCTTCTCCTCCAC-3' |
| AB077760-8 (SEQ. ID No. 174) | 5'-ATGAAGAAGGCCAGGGTGCTCACCGTGCTCT-3' |
| | |
| AB095645-5 (SEQ. ID No. 183) | 5'-AGGAGGCGGGATCGGGCGCGGGAAG-3' |
| AB095645-6 (SEQ. ID No. 184) | 5'-GAAACGTGGGCCATCGCCATTGAGCGAAA-3' |
| AB095645-7 (SEQ. ID No. 185) | 5'-TTCCTCTTCCTCCCATCGCGAACTCCT-3' |
| AB095645-8 (SEQ. ID No. 186) | 5'-TGCCGTTTCTGGAGCTGCCCTACTGA-3' |
| | |
| AF139664-5 (SEQ. ID No. 197) | 5'-AGAACAGGAGGAAGAAGGGGCGGGGCAA-3' |
| AF139664-6 (SEQ. ID No. 198) | 5'-TACGCCACCGACTCAAGGTACGTACGTAC-3' |
| AF139664-7 (SEQ. ID No. 199) | 5'-TCATTTTTCACAGTATCGACAAAATCCT-3' |
| AF139664-8 (SEQ. ID No. 200) | 5'-TGGGCAGGAAAAGGCATGGCCCACCCCA-3' |

| | |
|---|---|
| AF139664-9 (SEQ. ID No. 201) | 5'-TGCTTTGATTAATACAGCTCGCAGCGAC-3' |
| AF139665-5 (SEQ. ID No. 211) | 5'- CCGCCGACGACGATCGGCAGAGGGCCGGT-3' |
| AF139665-6 (SEQ. ID No. 212) | 5'- TCTTCTGTAGTATCGAAGGGATCCTTG-3' |
| AF139665-7 (SEQ. ID No. 213) | 5'- TCGCCGCGCGCGCGCGATGGGCGAGCT-3' |
| AF141964-5 (SEQ. ID No. 222) | 5'-GGGTTTTTCGGGGCGGGGAAGGCGCGGAGGGGGA-3' |
| AF141964-6 (SEQ. ID No. 223) | 5'-TGAAGTTGTCCATGCTTACTAATACTCAAA-3' |
| AF141964-7 (SEQ. ID No. 224) | 5'-ATTGGTTTTCCCATGCGTGTGATGGATATTC-3' |
| AF141964-8 (SEQ. ID No. 225) | 5'-GACCAAAACCAGCCCATGCTGCATGGTACACTATTAGGCT-3' |
| AF141964-9 (SEQ. ID No. 226) | 5'-CCTAATAAGAAACCGATGGGTATAAAATGGAGA-3' |
| AF141965-5 (SEQ. ID No. 236) | 5'-GAGAGATCGGGATCGATCGTGCGGCGGA-3' |
| AF141965-6 (SEQ. ID No. 237) | 5'-TCCAAGCGCCGGAAAGGCCTCCTCAAGAA-3' |
| AF141965-7 (SEQ. ID No. 238) | 5'-GAAAATGGAGGATGCAGAATATATATCCT-3' |
| AF141965-8 (SEQ. ID No. 239) | 5'-AACAACTGTTCCAAGGAGCATGTCCAC-3' |
| AF141965-9 (SEQ. ID No. 240) | 5'-CTTCTCGCGCGCCCGCGATTTCCGTT-3' |
| AF141965-10 (SEQ. ID No. 241) | 5'-TCTCCCCCCGCGGCGGCCTCTACGA-3' |
| AF174093-5 (SEQ. ID No. 250) | 5'-GGCGAGGTCGCGTTCGGCCAAGGGAA-3' |
| AF174093-6 (SEQ. ID No. 251) | 5'-GAAGATCGAGATCAAGAGGATCGAGGAC-3' |
| AF174093-7 (SEQ ID No. 252) | 5'-CCTGCTGTGCGAAGCGCAGGTCGGC-3' |
| AF174093-8 (SEQ ID No. 253) | 5'-AAGAAGGCCGAACCAGCTCGCCGTGC-3' |
| AF204063-5 (SEQ. ID No. 262) | 5'-AGCAGGAGGAAGAAGATCGGGAGGGGGAA-3' |
| AF204063-6 (SEQ. ID No. 263) | 5'-TCTCCAGCTCATCTTGGTACGTATAGCA-3' |
| AF204063-7 (SEQ. ID No. 264) | 5'-TTCACTTCCAGCATCTACAAAACCTTG-3' |
| AF204063-8 (SEQ. ID No. 265) | 5'-ATCTTCTCCGGCCGCCGCCGCCTCTT-3' |
| AF204063-9 (SEQ. ID No. 266) | 5'-GTCCAGCTAGCCAAGGATGGATATATTA-3' |
| AF345911-5 (SEQ. ID No. 275) | 5'-AGCGGCGAGGATCGGGCGGGGGAAGGT-3' |
| AF345911-6 (SEQ. ID No. 276) | 5'-GTTTTCCCTGCAGGATCGACAAAATCCT-3' |
| AF345911-7 (SEQ. ID No. 277) | 5'-CGGCCGCTTCCATCGATTTCAGCTGCT-3' |
| AF424549-5 (SEQ. ID No. 287) | 5'-AGGGGCGGCGATGGGGAGGGGCAAGAT-3' |
| AF424549-6 (SEQ. ID No. 287) | 5'-CCGCACGGCGATCATCAAGAAGGCCAG-3' |
| AF424549-7 (SEQ. ID No. 289) | 5'-AGCTTCGCCATCATCAAGTTCTCCTCCA-3' |
| AF424549-8 (SEQ. ID No. 290) | 5'-TTGCATCTATCCATCGTTAAAACAAGTC-3' |

| AJ293816-5 (SEQ. ID No. 299) | 5'-TGTGTGATCTGATAAGGCTGGCCGCGGCGGT-3' |
|---|---|
| AJ293816-6 (SEQ. ID No. 300) | 5'-TACATTGATGAAGCATCGAACAGATTATTG-3' |
| | |
| AY115556-5 (SEQ. ID No. 309) | 5'-CTTATCTTGATCGATCGCGCGAGGCAAG-3' |
| AY115556-6 (SEQ. ID No. 310) | 5'-TGAACAGAACCATCGAGGAGCTG-3' |
| AY115556-7 (SEQ. ID No. 311) | 5'-AGCTCTGATATAGCATGGAGGTTAATTG-3' |
| | |
| AY177695-5 (SEQ. ID No. 320) | 5'-TCGATCGATTGAAGAAGGGGAGAGGGA-3' |
| AY177695-6 (SEQ. ID No. 321) | 5'-GACAACACGAAGAACCGGCAGGTGAC-3' |
| AY177695-7 (SEQ. ID No. 322) | 5'-CGCGGCGGGCTGATCAAGAAGGCCGGGAG-3' |
| AY177695-8 (SEQ. ID No. 323) | 5'-CTTTTTGTTAGCATCAAATCAATAATA-3' |
| AY177695-9 (SEQ. ID No. 324) | 5'-TGAAGAGCAAACCATCGAGCTAACAAACACA-3' |
| AY177695-10 (SEQ. ID No. 325) | 5'-TCAGGGATGACAACACGATGGCACCATCAGTCAT-3' |
| | |
| AY177696-5 (SEQ. ID No. 334) | 5'-TAGCGGCGAAGAAGATCGGGAGGGGGAAGA-3' |
| AY177696-6 (SEQ. ID No. 335) | 5'-GAGGTCGGCCTCAAGATCTTCTCCAG-3' |
| AY177696-7 (SEQ. ID No. 336) | 5'-CAAATATGCAGCATCAAGTCAGTTAT-3' |
| AY177696-8 (SEQ. ID No. 337) | 5'-CAGCATGGGCCATCGCCAGCTCTTCTCT-3' |
| | |
| AY177698-5 (SEQ. ID No. 346) | 5'-ACCAACCTGATCAAAGGGGCGTGGGA-3' |
| AY177698-6 (SEQ. ID No. 347) | 5'-TCCAAGAGGAGGATCGGGCTGCTCAAGAAA-3' |
| AY177698-7 (SEQ. ID No. 348) | 5'-AGGCACTGGCAAGAAGTACGAGTACT-3' |
| | |
| AY177699-5 (SEQ. ID No. 360) | 5'-ATCGGCCAGAATCGGGAGGGGGCGCA-3' |
| | |
| AY177700-5 (SEQ. ID No. 370) | 5'-AAGAGTGAAACAACAAGGTCAGAGGA-3' |
| AY177700-6 (SEQ. ID No. 371) | 5'-GAAAGGTGCAAATCCGACGAATAGAG-3' |
| AY177700-7 (SEQ. ID No. 372) | 5'-ATTAGCTACTAAAGGGTGTGTTTCCA-3' |
| AY177700-8 (SEQ. ID No. 373) | 5'-AAAATGCAAGAAATTTCATAACTTG-3' |
| | |
| AY177702-5 (SEQ. ID No. 383) | 5'-GAGAGCGAGGAGATCGGGAGGGGGAAGA-3' |
| AY177702-6 (SEQ. ID No. 384) | 5'-TTACTTGCATGCTAGCTTGAAAACTGT-3' |
| AY177702-7 (SEQ. ID No. 385) | 5'-ATCCTAAATTTTCATCGATGGCATCTAG-3' |
| AY177702-8 (SEQ. ID No. 386) | 5'-GATCAGGACCATGCCAGTCTGATGGCCAA-3' |
| AY177702-9 (SEQ. ID No. 387) | 5'-GCACAAGGAAAGCCTTGGAACATCTT-3' |

| | |
|---|---|
| AY224482-5 (SEQ. ID No. 396) | 5'-GAGAGCGAGGAGATCGGGAGGGGCAAGA-3' |
| AY224482-6 (SEQ. ID No. 397) | 5'-CTTGCATGCTAGCTTGAAAACTGTGA-3' |
| AY224482-7 (SEQ. ID No. 398) | 5'-CTAAATTTTCATGCATGGCATCTAG-3' |
| AY224482-8 (SEQ. ID No. 399) | 5'-TGATCAGGACCATCGCAGTCTGATGG-3' |
| AY224482-9 (SEQ. ID No. 400) | 5'-CAAGGAAAGCCAAGGAACATCTTTAC-3' |
| | |
| AY250075-5 (SEQ. ID No. 409) | 5'-AGAGAGAGAGATGAAGGGGAGGGGGAA-3' |
| AY250075-6 (SEQ. ID No. 410) | 5'-TATTGATAGTATCGAGCGAATCCTTG-3' |
| AY250075-7 (SEQ. ID No. 411) | 5'-CAGTTGGTTGCCAAGGCGCGTTGCCGA-3' |
| AY250075-8 (SEQ. ID No. 412) | 5'-GAGCCTCGGCCATGCCCAGCTCCTTCCT-3' |
| AY250075-9 (SEQ. ID No. 413) | 5'-CTATTATTTTAAGAAAGCATGGATTATATAG-3' |
| AY250075-10 (SEQ. ID No. 414) | 5'-TGAGACAGACCCATGCCTGGGCCTAC-3' |
| | |
| L37527-5 (SEQ. ID No. 423) | 5'-GAGGAGTTGGATATCGGGCGCGGCAAGAT-3' |
| L37527-6 (SEQ. ID No. 424) | 5'-ACCTCCATTCCTTGCATGGCGGCCT-3' |
| L37527-7 (SEQ. ID No. 425) | 5'-TACTCCACTCCAACGATGGCGTCCAGT-3' |
| | |
| L37528-5 (SEQ. ID No. 436) | 5'-AGCATACCCATCCATCTTGAACATGATGGT-3' |
| L37528-6 (SEQ. ID No. 437) | 5'-CATCCATCTTGAACATCTTGGTAAATTCTGGCT-3' |
| | |
| U78891-5 (SEQ. ID No. 447) | 5'-AGATCGATCGGGATCGGGAGGGGTCGGGT-3' |
| U78891-6 (SEQ. ID No. 448) | 5'-GAACTTTGTAGCATCACTAAAACGCT-3' |
| U78891-7 (SEQ. ID No. 449) | 5'-GTCCATGAAACAAACCGATGGTAATTGC-3' |
| AF095646-5 (SEQ ID No. 512) | 5'-CAAAAGTTGAGGGATTGGATCGATCAGA-3' |
| AF095646-6 (SEQ ID No. 513) | 5'-GATTGGATCGATCAGAGATCGGGAGGGGAAGGGT-3' |
| AF095646-7 (SEQ ID No. 514) | 5'-GTTTTGTTTCCTTCGATGGGATGCGTATTC-3' |
| AF095646-8 (SEQ ID No. 515) | 5'-GAAGGCGTACGAGGTCTCCGTGCTCTG-3' |

| primers to mutagenize 3'-regulatory sequence | |
|---|---|
| name | sequence |
| AB003328-5 (SEQ. ID No. 162) | 5'- CGTATTGTCGTCCATGCATGCGAAATGCTA-3' |
| AB095645-9 (SEQ. ID No. 187) | 5'- GTAAAATTGCAGATCGATGGATGTCTCCA-3' |
| AB095645-10 (SEQ. ID No. 188) | 5'- GAACCTCTCCATGCCGTGCACCCCG-3' |
| AF139664-10 (SEQ. ID No. 202) | 5'-ACCTGACCCGGTCCCGTCGCCTGCTGCT-3' |

| | |
|---|---|
| AF141964-10 (SEQ. ID No. 227) | 5'-AGAGAAAAGAGTTGCCTTGGCCTCTGGCTCTGC-3' |
| AF345911-8 (SEQ. ID No. 278) | 5'-AGAACTATTCCAAGGTAATTGTACCATC-3' |
| AY177698-8 (SEQ. ID No. 349) | 5'-AGGAGGCCAACCTGCATGGCTACGTTCTT-3' |
| AY177698-9 (SEQ. ID No. 340) | 5'-GCTCGTTTGATCCAAGGACAAGATCA-3' |
| AY177698-10 (SEQ. ID No. 351) | 5'-TTCCTAAGGACACGATGGAGTCTGGA-3' |
| AY177699-6 (SEQ. ID No. 361) | 5'-AGTCGCCCCCGGCCTTTTAAGAGCCGCA-3' |
| AY177700-9 (SEQ. ID No. 374) | 5'-TAGGATTCATAACGATGGACATGTTC-3' |
| L37527-8 (SEQ. ID No. 426) | 5'-ACGGCAGCGGCCCGTCCGGCAGCTCCGGA-3' |
| L37527-9 (SEQ. ID No. 427) | 5'-GAACCTCTCCATCGCGCCGCCCCGGGGCT-3' |
| L37528-7 (SEQ. ID No. 438) | 5'-ATGTGAGGACCATCGATTGATGCATTG-3' |
| U78891-8 (SEQ. ID No. 450) | 5'-ACCTACATGCCCGCATGGCTACCATGAT-3' |
| U78891-9 (SEQ. ID No. 451) | 5'-TCGTCGTTTTCTCGATGGCCTTGCAT-3' |
| AF095646-9 (SEQ ID No. 516) | 5'-CCCTTCCTTACCCATGCTGGTAACAAATATG-3' |

| primers to clone 3'-regulatory sequence in pNOV6901 | |
|---|---|
| name | sequence |
| AB003322-9 (SEQ. ID No. 141) | 5'-TAATAAGAGCTCTGAAAGGAAAAAAAAGCA-3' |
| AB003322-10 (SEQ. ID No. 142) | 5'-ATATATGCGGCCGCGGTCCGAATAAATCTGGCAACTGA-3' |
| AB003324-10 (SEQ. ID No. 154) | 5'-ATATATGCGGCCGCGGTCCGTGGAGATCGAGCACAATTAAATTC-3' |
| AB003324-11 (SEQ. ID No. 155) | 5'-TAGGTAGAGCTCCTAGCTAGCTAGCTACCGTTTCA-3' |
| AB003328-6 (SEQ. ID No. 163) | 5'-TAATAAGAGCTCGTAACAGGCCAGGAATAAGCT-3' |
| AB003328-7 (SEQ. ID No. 164) | 5'-ATATATGCGGCCGCGGTCCGATTGCCGGGCTATAGCCTT-3' |
| AB077760-11 (SEQ. ID No. 175) | 5'-ATGCATGAGCTCTATATCATCGCCGC-3' |
| AB077760-12 (SEQ. ID No. 176) | 5'-ATATATGCGGCCGCGGTCCGTGGTACTGAAATC-3' |

| | |
|---|---|
| AB095645-13 (SEQ. ID No. 189) | 5'- TAATAAGAGCTCGCTGCTAGGTTGCCCCGCCACT-3' |
| AB095645-14 (SEQ. ID No. 190) | 5'- TAATAAGCGGCCGCGGTCCGCACGGCTACCTCTCGCCGGA-3' |
| AF139664-11 (SEQ. ID No. 203) | 5'- TAATAAGAGCTCGGAGGCTTCAGATCCATACCA-3' |
| AF139664-12 (SEQ. ID No. 204) | 5'- ATATATGCGGCCGCGGTCCGGATAAACATTGTGAAGCAAC-3' |
| AF139665-8 (SEQ. ID No. 214) | 5'-TGATGAGCGGCCGCAGGCATCTGTTGATCTCA-3' |
| AF139665-9 (SEQ ID No. 215) | 5'-TATATAACTAGTGCGGTCCGATGAACTCCACCTCGGGAAC-3' |
| AF141964-11 (SEQ. ID No. 228) | 5'-TGATGAGCGGCCGCAGGAAGCACAGGTGT-3' |
| AF141964-12 (SEQ. ID No. 229) | 5'-ATATATCCCGGGCGGTCCGATGAGATACAATCTAGTAC-3' |
| AF141965-11 (SEQ. ID No. 242) | 5'-TGATGAGCGGCCGCAGAAGGCCAGCCACA-3' |
| AF141965-12 (SEQ. ID No. 243) | 5'-TATATACCCGGGCGGTCCGCCTTATCGAATATTCA-3' |
| AF174093-10 (SEQ. ID No. 254) | 5'-TGATGAGAGCTCCTTCCTGGAAGCAGTAG-3' |
| AF174093-11 (SEQ. ID No. 255) | 5'-ATATATGCGGCCGCGGTCCGCCCCTTCTCCTCCTCCGGGA-3' |
| AF204063-10 (SEQ. ID No. 267) | 5'-TATATACCCGGGCGGTCCGCTGCATATACTTGCAACA-3' |
| AF204063-11 (SEQ. ID No. 268) | 5'-TGATGAGCGGCCGCTGTGTGTTCAGTTCAG-3' |
| AF345911-9 (SEQ. ID No. 279) | 5'-TAATAAGCGGCCGCGATGATCATCGTCGTCGT-3' |
| AF345911-10 (SEQ. ID No. 280) | 5'-TATATACCCGGGCGGTCCGTTGACTTAAATGGCAAG-3' |
| AF424549-9 (SEQ. ID No. 291) | 5'-TGATGAGCGGCCGCGATATCATCGCCGCCG-3' |
| AF424549-10 (SEQ. ID No. 292) | 5'-TATATACCCGGGCGGTCCGTTTTATTATCTTGGCGA-3' |
| AJ293816-7 (SEQ. ID No. 301) | 5'-TGATGAGCGGCCGCTGGCTGGAAACTAAAACT-3' |
| AJ293816-8 (SEQ. ID No. 302) | 5'-TATATACCCGGGCGGTCCGTTTGAAACATTTCGGCCCT-3' |
| AY115556-8 (SEQ. ID No. 312) | 5'-TAATAAGCGGCCGCACTAATAATGGCCTGG-3' |
| AY115556-9 (SEQ. ID No. 313) | 5'-TATATACCCGGGCGGTCCGAACTTTGCACGAATG-3' |
| AY177695-11 (SEQ ID No. 325) | 5'-TAATAAGAGCTCCACATGATCAAGTGTTAAAAAC-3' |
| AY177695-12 (SEQ. ID No. 326) | 5'-TATATAGCGGCCGCGGTCCGGCTCGGTCAAACCAGCGT-3' |
| AY177696-9 (SEQ. ID No. 338) | 5'-TGATGAGAGCTCCCAGAAAAACATTGTTTTG-3' |
| AY177696-10 (SEQ. ID No. 339) | 5'-TATATAGCGGCCGCGGTCCGTTTGGGATTGGAC-3' |

| | |
|---|---|
| AY177698-11 (SEQ. ID No. 325) | 5'-TGATGAGCGGCCGCTTGCCCTCTTTCCATC-3' |
| AY177698-12 (SEQ. ID No. 353) | 5'-TATATACCCGGGCGGTCCGTTAACCTAAAAGAAAT-3' |
| AY177699-7 (SEQ. ID No. 362) | 5'-TAGTAGGCGGCCGCAAACAGATGGACGCTTGA-3' |
| AY177699-8 (SEQ. ID No. 363) | 5'-TATATACCCGGGCGGTCCGAGGCTTGGTGCAAG-3' |
| AY177700-10 (SEQ. ID No. 375) | 5'-TAGTAGGCGGCCGCGTCAAAGGACCT-3' |
| AY177700-11 (SEQ. ID No. 376) | 5'-TATATACCCGGGCGGTCCGTAATTTTACTAGTACT-3' |
| AY177702-10 (SEQ. ID No. 388) | 5'-TAATAAGAGCTCGACTATGCCGTACAAGC-3' |
| AY177702-11 (SEQ. ID No. 389) | 5'-ATATATGCGGCCGCGGTCCGTGGTTGTCACAG-3' |
| AY224482-10 (SEQ. ID No. 401) | 5'-TAATAAGAGCTCGACTATGCCGTACAAGC-3' |
| AY224482-11 (SEQ. ID No. 402) | 5'-TATATAGCGGCCGCGGTCCGTGGTTGTCACAGA-3' |
| AY250075-11 (SEQ. ID No. 415) | 5'-TAGTAGAGCTCAAGATGTTCAGATGAAATG-3' |
| AY250075-12 (SEQ. ID No. 416) | 5'-TATATAGCGGCCGCGGTCCGAAAAAAATCACCGGCGT-3' |
| L37527-10 (SEQ. ID No. 428) | 5'-TAGTAGAGCTCGCTGCTGAGCACTGCCA-3' |
| L37527-11 (SEQ. ID No. 429) | 5'-TATATAGCGGCCGCGGTCCGTGCTGGTGCTCGAGGT-3' |
| L37528-8 (SEQ. ID No. 439) | 5'-TAGTAGAGCTCTTTTGGTGTAGACACC-3' |
| L37528-9 (SEQ. ID No. 440) | 5'-ATATAGCGGCCGCGGTCCGTGAAAGCTACATTTTAGC-3' |
| U78891-10 (SEQ. ID No. 452) | 5'-TGATGAGCTCACAGTGCGTGCATGAACA-3' |
| U78891-11 (SEQ. ID No. 453) | 5'-TATATAGCGGCCGCGGTCCGATGTTTTTTTTGTCTTTTGATGC-3' |
| AF095646-10 (SEQ ID No. 517) | 5'-ATATATCTCGAGCCGACCGTGTTGCATGCATGCGTACTGGTGA-3' |
| AF095646-11 (SEQ ID No. 518) | 5'-ATATATCCATGGTGGGTTTATTCTGCAAACAAAAATAG-3' |

| primers to clone 5'-regulatory sequence in pNOV6901 | |
|---|---|
| name | sequence |
| AB003322-10 (SEQ. ID No. 142) | 5'-TATATACCATGGTGGTGATACTGTCCAACAGAAGG-3' |
| AB003322-11 (SEQ. ID No. 143) | 5'-ATATATGGATCCGGACCGTTGCCCAGCGAGGAGCATG-3' |
| AB003324-12 (SEQ. ID No. 156) | 5'-ATATATGGATCCGGACCGTCTAAATAGGGCCCAACATAC-3' |
| AB003324-13 (SEQ. ID No. 157) | 5'-TATATACCATGGTGGCTTAAGGATGCTGAAATATGA-3' |

| | |
|---|---|
| AB003328-8 (SEQ. ID No. 165) | 5'- TATATAGGATCCGGACCGAACAAAACCAATAATCTCCAATG-3' |
| AB003328-9 (SEQ. ID No. 166) | 5'- TATATACCATGGTGGATCGCCGATGAACCAACCAAC-3' |
| AB077760-9 (SEQ. ID No. 177) | 5'- ATATATGTCGACGGACCGATTCGTTGGGGGTGACATGAC-3' |
| AB077760-10 (SEQ. ID No. 178) | 5'- TACAGTACCATGGTGGCCCTTGATGCTGCAGCAGGAT-3' |
| AB095645-11 (SEQ. ID No. 191) | 5'- GAGAGACCTGCAGGCGGACCGCTCGTCGCCGTCGTTGGCTCGGCGT-3' |
| AB095645-12 (SEQ. ID No. 192) | 5'- ATATATCCATGGTGGTTGATAGCCTTATACATGTCCC-3' |
| AF139664-13 (SEQ. ID No. 205) | 5'- ATATATGGATCCGGACCGTGCATCCTTACAAAGAGACA-3' |
| AF139664-14 (SEQ. ID No. 206) | 5'- TATATACCATGGTGGTTGTCCATACTGTGAAAAATG-3' |
| AF139665-10 (SEQ. ID No. 216) | 5'-ATATATGTCGACGGACCGACCTGGGGTTTGGAAATG-3' |
| AF139665-11 (SEQ. ID No. 217) | 5'-TATATACCATGGTGGCCTTCCATACTACAGAAG-3' |
| AF141964-13 (SEQ. ID No. 230) | 5'-ATATATCCTGCAGGCGGACCGAAAACACTGATTAAAGGGT-3' |
| AF141964-14 (SEQ. ID No. 231) | 5'-ATATATCCATGGTGGCCTTCAATGCTGAAAAAGAAAAC-3' |
| AF141965-13 (SEQ. ID No. 244) | 5'-ATATATGGATCCGGACCGTGTTTCTCGATTAGGCTAC-3' |
| AF141965-14 (SEQ. ID No. 245) | 5'-ATATATCCATGGTGGTCTGTAGGCTGCAGAACAGACAC-3' |
| AF174093-12 (SEQ. ID No. 256) | 5'-TATATCCTGCAGGCGGACCGAAAATTCACAAGTATAATTC-3' |
| AF174093-13 (SEQ. ID No. 257) | 5'-TATATACCATGGTGGTCAAGCTTAACAAAGCAT-3' |
| AF204063-12 (SEQ. ID No. 269) | 5'-TATATAGGATCCGGACCGACAAATTTGTTGTACCAC-3' |
| AF204063-13 (SEQ. ID No. 270) | 5'-ATATATCCATGGTGGTGTACATGCTGGAAGTGA-3 |
| AF345911-11 (SEQ. ID No. 281) | 5'-TATATAGTCGACGGACCGAAAATCTCAAGGTTTC-3' |
| AF345911-12 (SEQ. ID No. 282) | 5'-TATATACCATGGTGGTTGTCGATCCTGCAGGGAA-3' |
| AF424549-11 (SEQ. ID No. 293) | 5'-TATATAGTCGACGGACCGTACAAAGTGCTGGAAGT-3' |
| AF424549-12 (SEQ. ID No. 294) | 5'-TATATACCATGGTGGTGATGCTGCAGCAGGATGCA-3' |
| AJ293816-9 (SEQ. ID No. 303) | 5'-TATATAGTCGACGGACCGCAAACATTTTAAACTTTAAC-3' |
| AJ293816-10 (SEQ. ID No. 304) | 5'-TATATACCATGGTGGTGTTCGATGCTTCATCAATGT-3' |
| AY115556-10 (SEQ. ID No. 314) | 5'-TATATACCTGCAGGCGGACCGATATAAAAACCTACTTTATG-3' |

| | |
|---|---|
| AY115556-11 (SEQ. ID No. 315) | 5'-ATATATCCATGGTGGCGATGGTTCTGTTCAAAGAAATC-3' |
| AY177695-13 (SEQ. ID No. 328) | 5'-TATATAGGATCCGGACCGTCAGTCCATCATTTCGTC-3' |
| AY177695-14 (SEQ. ID No. 329) | 5'-TATATACCATGGTGGATTTGATGCTAACAAAAAGG-3' |
| AY177696-11 (SEQ. ID No. 340) | 5'-TATATAGGATCCGGACCGCAAGCAAAGAAACAAATTTCG-3' |
| AY177696-12 (SEQ. ID No. 341) | 5'-ATATACCATGGTGGCTTGATGCTGCATATTTG-3' |
| AY177698-13 (SEQ. ID No. 354) | 5'-TATATAGGATCCGGACCGAAGATTTGAACTACTGCCT-3' |
| AY177698-14 (SEQ. ID No. 355) | 5'-TATATACCATGGTGGTTTGCAATCCTGCCA-3' |
| AY177699-9 (SEQ. ID No. 364) | 5'-TATATAGGATCCGGACCGTCCGGTCGGCCCTCGTCCT-3' |
| AY177699-10 (SEQ. ID No. 365) | 5'-TATATACCATGGTGGCTCACGCTGCGCCA-3' |
| AY177700-12 (SEQ. ID No. 377) | 5'-TATATAGGATCCGGACCGATAAGTATTTCAGAAAG-3' |
| AY177700-13 (SEQ. ID No. 378) | 5'-TATATACCATGGTGGGCAAATTTCTTGCATTTTG-3' |
| AY177702-12 (SEQ. ID No. 390) | 5'-TATATAGTCGACGGACCGTCTTTTCGCAAACTAAAC-3' |
| AY177702-13 (SEQ. ID No. 391) | 5'-TATATACCATGGTGGTCAAGCTAGCATGCAAG-3' |
| AY224482-12 (SEQ. ID No. 403) | 5'-TATATAGTCGACGGACCGTCTTTTCGCAAACTAAACAAGG-3' |
| AY224482-13 (SEQ. ID No. 404) | 5'-TATATACCATGGTGGTTTTCAAGCTAGC-3' |
| AY250075-13 (SEQ. ID No. 417) | 5'-TATATACCTGCAGGCGGACCGAAATGGTTTCATTTTGG-3' |
| AY250075-14 (SEQ. ID No. 418) | 5'-TATATACCATGGTGGCGCTCGATACTATCA-3' |
| L37527-12 (SEQ. ID No. 430) | 5'-TATATACCTGCAGGCGGACCGCCAAGAGAGCCCCCT-3' |
| L37527-13 (SEQ. ID No. 431) | 5'-TATATACCATGGTGGTTGACAGCCTAAAACG-3' |
| L37528-10 (SEQ. ID No. 441) | 5'-TATATAGGATCCGGACCGACCACCTCAATCTCCACT-3' |
| L37528-11 (SEQ. ID No. 442) | 5'-TATATACCATGGTGGATCGGTCTGGACA-3' |
| U78891-12 (SEQ. ID No. 454) | 5'-TATATAGGATCCGGACCGTCTTCTTCTTGCCTTCATTTG-3' |
| U78891-13 (SEQ. ID No. 455) | 5'-TATATACCATGGTGGTTAGTGATGCTACAAAGTTC-3' |
| AF095646-12 (SEQ ID No. 519) | 5'-TATATAGAGCTCAGTCCAAGCTTGCTAATAAAAACGCT-3' |
| AF095646-13 (SEQ ID No. 520) | 5'-TATATACCCGGCGGTCCGAAGGGTAGGGCTGCACGAA-3' |

CERTIFICATE OF CORRECTION (continued)
U.S. Pat. No. 8,129,588 B2

Column 51, Lines 54-67: Please replace the paragraph in its entirety with the following:

4.0 µL 11082 (NcoI/SacI/CIP) was ligated to 4.0 µL OsT6PP-3 (NcoI/SacI) in a 10 µL reaction mixture containing 1 µL 10X T4 DNA ligase buffer and 1 µL T4 DNA ligase (400 Units/µL). The reaction mixture was incubated more than 8 hours at 16°C. 5.0 µL of ligation mixture was transformed into 50 µL Top10 competent cells. The recombinants were verified by digesting 7.5 µL 11082-OsT6PP-3 miniprep DNA with 1.0 µL RsrII in 10 µL reaction mixtures containing 1 µg BSA and 1 µL 10X restriction endonuclease buffer. The digests were incubated at 37°C for 2 hours then resolved on 1% TAE agarose. Positive 11082-OsT6PP-3 recombinants were sequenced. The vector was designated OsMADS6-OsT6PP-Assembly and is shown in FIG. 11A.

Column 52, Lines 23-38: Please replace the paragraph in its entirety with the following:

4.0 µL pNOV6900 (RsrII/CIP) was ligated to 4.0 µL pNOV6906-OsT6PP-Assembly (RsrII) in a 10 µL ligation mixture containing 1 µL 10X T4 DNA ligase buffer and 1 µL T4 DNA ligase (400 U/µL). The ligation mixture was incubated more than 8 hours at 16°C. 5.0 µL of ligation mixture was transformed into 50 µL Top10 competent cells. The pNOV6900-pNOV6906-OsT6PP-Assembly recombinants were verified by digesting 7.5 µL miniprep DNA with 1.0 µL NcoI in 10 µL reaction mixtures containing 1 µg BSA and 1 µL 10X restriction endonuclease buffer. The digests were incubated at 37°C for 2 hours then resolved on 1% TAE agarose. Positive pNOV6900-pNOV6906-OsT6PP-Assembly recombinants were sequenced. The finished clone was designated OsMADS6-OsT6PP-Binary and is shown in FIG 11B. The plasmid's QC number is 12194.